US008101819B2

(12) United States Patent
Roesler et al.

(10) Patent No.: US 8,101,819 B2
(45) Date of Patent: Jan. 24, 2012

(54) DGAT GENES FOR INCREASED SEED STORAGE LIPID PRODUCTION AND ALTERED FATTY ACID PROFILES IN OILSEED PLANTS

(75) Inventors: Keith Roesler, Urbandale, IA (US); Knut Meyer, Wilmington, DE (US); Howard Glenn Damude, Hockessin, DE (US); Bo Shen, Johnston, IA (US); Changjiang Li, Urbandale, IA (US); Ericka Bermudez, Aptos, CA (US); Mitchell C. Tarczynski, West Des Moines, IA (US)

(73) Assignees: E. I. duPont de Nemours and Company, Wilmington, DE (US); Pioneer Hi-Bred International, Inc., Johnston, IA (US)

( * ) Notice: Subject to any disclaimer, the term of this patent is extended or adjusted under 35 U.S.C. 154(b) by 271 days.

(21) Appl. No.: 12/470,569

(22) Filed: May 22, 2009

(65) Prior Publication Data
US 2009/0293152 A1   Nov. 26, 2009

Related U.S. Application Data

(60) Provisional application No. 61/055,579, filed on May 23, 2008.

(51) Int. Cl.
*A01H 1/00* (2006.01)
*A01H 5/00* (2006.01)
*A01H 5/10* (2006.01)
*A01H 15/00* (2006.01)
*C12N 5/14* (2006.01)
*C07H 21/04* (2006.01)

(52) U.S. Cl. ........ 800/278; 800/281; 800/298; 800/306; 800/312; 800/314; 800/320.1; 800/322; 800/297; 435/410; 435/419; 435/468; 536/23.6

(58) Field of Classification Search ........................ None
See application file for complete search history.

(56) References Cited

U.S. PATENT DOCUMENTS

| | | | |
|---|---|---|---|
| 6,100,077 | A | 8/2000 | Sturley et al. |
| 6,344,548 | B1 | 2/2002 | Farese, Jr. et al. |
| 2003/0115632 | A1 | 6/2003 | Lardizabal et al. |
| 2005/0160494 | A1 | 7/2005 | Singletary et al. |
| 2006/0094088 | A1 | 5/2006 | Picataggio et al. |

FOREIGN PATENT DOCUMENTS

| | | |
|---|---|---|
| WO | 9832326 | 7/1998 |
| WO | 9855631 | 12/1998 |
| WO | 0001713 | 1/2000 |
| WO | 0032756 | 6/2000 |
| WO | WO 03/078639 A2 | 9/2003 |
| WO | 2004011671 | 2/2004 |
| WO | 2005003322 | 1/2005 |
| WO | WO 2006/127655 A2 | 11/2006 |
| WO | WO 2007/101273 A2 | 9/2007 |
| WO | WO 2008/006207 A2 | 1/2008 |

OTHER PUBLICATIONS

He, X., et al., "Cloning and Characterization of a cDNA Encoding Diacylglycerol Acyltransferase From Castor Bean," *Lipids*, 2004, pp. 311-318, vol. 39(4).
Saha, S., et al., "Cytosolic Triacylglycerol Biosynthetic Pathway in Oilseeds. Molecular Cloning and Expression of Peanut Cytosolic Diacylglycerol Acyltransferase," *Plant Physiology*, 2006, pp. 1533-1543, vol. 141(4).
Siloto, R.M.P., et al., "Directed Evolution of Acyl-CoA: Diacylglycerol Acyltransferase: Development and Characterization of Brassica Napus DGAT1 Mutagenized Libraries," *Plant Physiology and Biochemistry*, 2009, pp. 456-461, vol. 47(6).
Database Accession No. AY445635, 2004.
National Center for Biotechnology Information General Identifier No. 56199782, Accession No. AA578662, Jan. 25, 2005, H. Wang et al.
National Center for Biotechnology Information General Identifier No. 93204650, Accession No. BAE93460, Jun. 17, 2006, T. Hatanaka et al. Diacylglycerol Acyltransferase-1 of Glycine max, mRNA Complete Code.
National Center for Biotechnology Information General Identifier No. 187806722, Accession No. CAQ43148, May 8, 2008, W. B. Allen, et al. Compositions related to the Quantitative Trait Locus 6 (qt16) in Maize and Method of Use.
National Center for Biotechnology Information General Identifier No. 91152592, Accession No. ABE24132, Apr. 5, 2006, J. Zou et al. Diacylglycerol Acyltransferase Gene from Plants.
National Center for Biotechnology Information General Identifier No. 225444869, Accession No. XP_002279345, Mar. 20, 2009.
National Center for Biotechnology Information General Identifier No. 147859067, Accession No. CAN80418, Feb. 5, 2008, R. Velasco, et al. A High Quality Draft Consensus Sequence of the Genome of a Heterozygous Grapefine Variety.
National Center for Biotechnology Information General Identifier No. 157092192, Accession No. ABV21946, Mar. 6, 2008, K. Yu et al. Cloning and Functional Analysis of Two Type 1 Diacylglycerol Acyltransferase from Vernonia Galamensis.
National Center for Biotechnology Information General Identifier No. 86279632, Accession No. ABC94471, Sep. 13, 2006, J. M. Shockey, et al. Tung Tree DGAT1 and DGAT2 have Nonredundant Functions in Triacylglycerol Biosynthesis and are Localized to Different Subdomains of the Endoplasmic Reticulum.
National Center for Biotechnology Information General Identifier No. 67043496, Accession No. AAM03340, Jun. 8, 2005, E. Mietkiewska et al. Characterization of a Putative Diacylglycerol Acyltransferase mRNA from Tropaeolum Majus Embryo.
National Center for Biotechnology Information General Identifier No. 224087975, Accession No. XP_002308278, Feb. 26, 2009, G. A. Tuskan et al. The Genome of Black Cottonwood, Populus Trichocarpa.

(Continued)

*Primary Examiner* — Eileen B O Hara
(74) *Attorney, Agent, or Firm* — Alston & Bird LLP

(57) ABSTRACT

Transgenic oilseeds having increased total fatty acid content of at least 10% and altered fatty acid profiles when compared to the total fatty acid content of null segregant oilseeds are described. Novel DGAT genes are used to achieve the increase in seed storage lipids.

45 Claims, 11 Drawing Sheets

OTHER PUBLICATIONS

Figure 1:
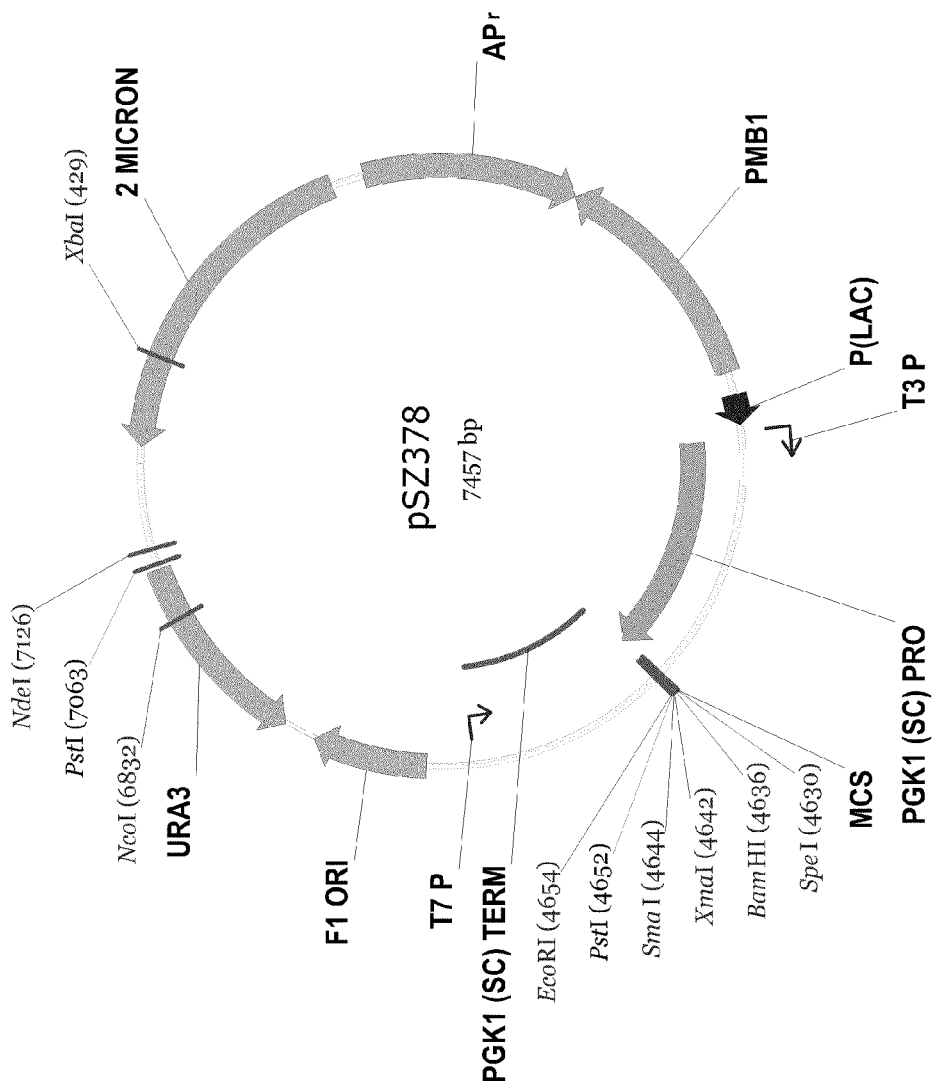

National Center for Biotechnology Information General Identifier No. 57231736, Accession No. AAW47581, Jul. 25, 2006, H. W. Wang et al. Cloning and Comparative Analysis of the Gene Encoding Diacylglycerol Acyltransferase from Wild Type and Cultivated Soybean.

National Center for Biotechnology Information General Identifier No. 53791817, Accession No. BAD53762, Feb. 16, 2008, T. Sasaki et al. Oryza Sativa Nipponbare (GA3) Genomic DNA, Chromosome 6, PAC Clone: P0656E03.

National Center for Biotechnology Information General Identifier No. 51854436, Accession No. AAU10815, Sep. 2, 2004, T. Chow et al. Oryza Sativa PAC P0636E04 Genomic Sequence.

National Center for Biotechnology Information General Identifier No. 41387497, Accession No. AAS01606, Jul. 1, 2004, K. Giannoulia et al. Olive DGAT1 cDNA.

National Center for Biotechnology Information General Identifier No. 124361135, Accession No. ABN09107, Mar. 24, 2007, C. D. Town.

National Center for Biotechnology Information General Identifier No. 57545061, Accession No. AAW51456, Jul. 26, 2006, H. W. Wang et al., Cloning and Comparative Analysis of the Gene Encoding Diacylglycerol Acyltransferase from Wild Type and Cultivated Soybean.

National Center for Biotechnology Information General Identifier No. 82582915, Accession No. ABB84383, Mar. 1, 2006, R. Qing et al. Identification and Characterization of a Novel Diacylglycerol Acyltransferase Gene from Jatropha Curcas.

National Center for Biotechnology Information General Identifier No. 118800682, Accession No. ABL16531, Dec. 6, 2006, A. Milcamps et al. Diacylglycerol Acyltransferase Genes, Proteins, and Uses Thereof.

National Center for Biotechnology Information General Identifier No. 7576941, Accession No. AAF64065, Apr. 16, 2000, A. P. Brown et al. Characterization of a Putative Diacylglycerol Acyltransferase cDNA from Brassica Napus Embryo.

National Center for Biotechnology Information General Identifier No. 127266368, Accession No. EJ536755, Mar. 8, 2007, D. B. Rusch et al. The Sorcerer II Global Ocean Sampling Expedition: Northwest Atlantic through Eastern Tropical Pacific.

National Center for Biotechnology Information General Identifier No. 187806720, Accession No. CAQ43147, May 8, 2008, W. B. Allen et al. Compositions Related to the Quantitative Trait Locus 6 (qt16) in Maize and Methods of Use.

National Center for Biotechnology Information General Identifier No. 91152589, Accession No. ABE24129, Apr. 5, 2006, J. Zou et al. Diacylglycerol Acyltransferase Gene from Plants.

National Center for Biotechnology Information General Identifier No. 91152588, Accession No. ABE24128, Apr. 5, 2006, J. Zou et al. Diacylglycerol Acyltransferase Gene from Plants.

National Center for Biotechnology Information General Identifier No. 10803053, Accession No. AAG23696, Oct. 16, 2000, S. Hwang et al. Isolation of Perilla Frutescens Diacylglycerol Acyltransferase cDNA.

Lardizabal et al., Journal of Biological Chemistry. DGAT2 is a New Diacylglycerol Acyltransferase Gene Family: Purification, Cloning and Expression in Insect Cells of Two Polypeptides from Mortierella Ramanniana with Diacylglycerol Acyltransferase Activity, vol. 276 (42), p. 38862-38869, Jul. 31, 2001.

Jako et al., Plant Physiology. Seed-Specific Over-Expression of an Arabidopsis cDNA Encoding a Diacylglycerol Acyltransferase Enhances Seed Oil Content and Seed Weight, vol. 126, p. 861-874, 2001.

Weselake et al., Journal of Experimental Botony. Metabolic Control Analysis is Helpful for Informed Genetic Manipulation of Oilseed Rape (*Brassica napus*) to Increase Seed Oil Content, vol. 59 (13), p. 3543-3549, Aug. 13, 2008.

Xut et al., Plant Biotechnology Journal. Cloning and Characterization of an acyl-CoA-Dependent Diacylglycerol Acyltransferase 1 (DGAT1) Gene from Tropaeolum Majus, and a Study of the Functional Motifs of the DGAT Protein Using Site-Directed Mutagenesis to Modify Enzyme Activity and Oil Content, vol. 6, p. 799-818, 2008.

Lardizabal et al. Plant Physiology. Expression of Umbelopsis Ramanniana DGAT2A in Seed Increases Oil in Soybean, vol. 148, p. 89-96, 2008.

Gunstone et al. The Lipid Handbook, 2nd Ed, Chapman and Hall, 2-6 Boundary Row, London SE1 8 HN, UK, p. 112, 1978.

National Center for Biotechnology Information General Identifier No. 5123718, Accession No. CAB45373, Jun. 18, 1999, J. Zou et al. The Arabidopsis Thaliana TAG1 Gene Encodes for a Diacylglycerol Acyltransferase.

Milcamps et al., Journal of Biological Chemistry. Isolation of a Gene Encoding a 1-2,Diacylglycerol-sn-acetyl-CoA Acetyltransferase from Developing Seeds of Euonymus Alatus, vol. 280 (7), p. 5370-5377, Feb. 18, 2005.

Hara et al., Analytical Biochemistry. Lipid Extraction of Tissues with a Low Toxicity Solvent, vol. 90, p. 420-426, Feb. 8, 1978.

Stemmer, W. P. C. Proc. Natl. Acad. Sci. USA. DNA Shuffling by Random Fragmentation and Reassembly: In Vitro Recombination for Molecular Revolution, vol. 91, p. 10747-10751, 1994.

Ness et al., Nature Biotechnology. Synthetic Shuffling Expands Functional Protein Diversity by Allowing Amino Acids to Recombine Independently, vol. 20, p. 1251-1255, Nov. 11, 2002.

Greenspan et al., Journal of Cell Biology. Nile Red: A Selective Fluorescent Stain for Intracellular Lipid Droplets, vol. 100, p. 965-973, Mar. 1, 1985.

Zheng et al., Nature Genetics. A phenylalanine in DGAT is a Key Determinant of Oil Content and Composition in Maize, vol. 40 (3), p. 367-372, 2008.

Cristofori et al., Journal Science Food Agric. Title vol. 88, p. 10981-1098, Year, 2008.

U.S. Appl. No. 12/470,509, filed May 22, 2009, E. I. du Pont de Nemours and Company.

U.S. Appl. No. 12/470,517, filed May 22, 2009, E. I. du Pont de Nemours and Company.

U.S. Appl. No. 12/469,026, filed May 20, 2009, E. I. du Pont de Nemours and Company.

National Center for Biotechnology Information General Identifier No 93204562, Accession No AB257589, Jun. 17, 2006, T. Hatanaka, et al. Diacylglycerol Acyltransferase-1 of Glycine max, mRNA Complete Code.

National Center for Biotechnology Information General Identifier No 63376226, Accession No DQ016106, May 17, 2005, N. Ilaiyaraja, et al. Isolation and Characterization of a Partical cDNA Encoding Diacylglycerol Acyltransferase (BjDGAT1) from Brassica Juncea Cultivar Pusa Bold.

FIGURE 5A

```
Majority      MAISDS--------------PESVATA------------LDISSLRRRPSAS-----------SSAG-LF--------DSPS-TTTDSGADAXXRDSGS---------------DGSXN--SD------V
SEQIDNO:12    MAISDM--------------PESTGFTATTA---------TMPHGGSDLRRRENAT--------ETTE-VS--------DSNS-KTTDPDSGNSVRESVRVRDSSTDESLARKSCEDDGSRSEVVIESANPV
SEQIDNO:153   MAISDE--------------PESVATA-------------LNHSSLRRRPSAT----------STAG-LF--------NSPE-TTTDSSGDDLAKDSGS---------------DDSIN--SDDA----AV
SEQIDNO:195   MAISDE--------------PESVATA-------------LNHSSLRRRPAAT----------STAG-LF--------NSPE-TTTDSSGDDLAKDSGS---------------DDSIN--NDDA----AV
SEQIDNO:16    MAISDE--------------PESVATA-------------LNHSSLRRRPSAT----------STAG-LF--------NSPE-TTTDSSGDDLAKDSGS---------------DDSIS--SDDA----AV
SEQIDNO:196   MAISDE--------------PETVATA-------------LNHSSLRRRP-------------TAAG-LF--------NSPE-TTTDSSGDDLAKDSGS---------------DDSIS--SD------AA
SEQIDNO:197   MAISDE--------------PETVATA-------------LNHSSLRRRP-------------STAG-LF--------NSPE-TTTDSSGDDLAKDSGS---------------DDSIS--SD------AA
SEQIDNO:198   MAISDE--------------PESVATA-------------LNHSSLRRRPSAT----------STAG-LF--------NSPE-TTTDSSGDDLAKDSGS---------------DDSIN--SDDA----AV
SEQIDNO:199   MAPPPSMP--A--ASDRAGPGRDAG---------------DSSSLRLRRAPS----------ADAGDLAG------DSSV-GLRENG-EPQPP--------------------TNPPP----------G
SEQIDNO:200   MAILDS--------------AGVTVTIENGGGE-------FVDLDRLRRRKSRS----------DSSNGLLLS-----GSDNNS-PSDDVGAPDVRDRIDSVVN----DDAQGTANLAGDNNG-------G
SEQIDNO:201   MAICNS--------------PVSVTTSSSSS---------HADSDLDFSIRKRFGG--------KGKA-VA-------DSSL-ETETEAAAAAVLE-----------------AEKSVGEVGSGGDRGESGSQVV
SEQIDNO:202   MAICNS--------------PVSVTTSSSSS---------HADSDLDFSIRKRFGG--------KGKA-VA-------DSSL-ETETEAAAAAVLE------------------AEKSV-----------V
SEQIDNO:203   MALLDT--------------PQIGEIT-----T-------IATTTIRQHPLGK-----------PDAG-IG-------DGLF-SSSSSKTNSSFEDGDS---------------LNGDFNDKFKEQIG----AG
SEQIDNO:204   MALLDT--------------PQIGEIT-----T-------TATTTIRRRTTVK------------PDAG-IG-------DGLFDSSSSKTNSSFEDGDS---------------LNGDFNDKFKEQIG----AG
SEQIDNO:205   MTIPETPDNSTDATTSSGAES-SS----------------D-NLSLRRRRTAS-----------NSDGAVA------ELAS-KIDELESDAGGGQVIKDPGA--EMDSGTLKSNG--KDCG---------TV
SEQIDNO:206   MAVAES--------------SQNTTMSGHGD---------SDLNNFRRRKPSSS----------VIEPSSSGFTS---TNGV-PAT--GHVAENRDQDRVGAM--ENATGSVNLIGNGGG---------V
SEQIDNO:207   ----------------------------------------------------------------------------------------------------------------MMESEDLIKSNG--KEC
SEQIDNO:208   MAILDS--------------PEILDTTSSSADNG------AAHHTTLRRRQSARSVPPLDSDSNSLEAESAINDSEN-VRNDANLIENLRGGAVE------SENEKQESYGKE-------EG
SEQIDNO:209   MVGSDG--------------DGDGGGGEAHAP--------AAPAHHHRRPPRP-----------RGGSGAIVEG----FAAALRRRIRSGAAAARASFGG---DSGDEAASGEPSSSSSSPSRRRG
SEQIDNO:210   MAPPPSL-------------APDRGGGEPDD---------ALRLRAEAA---------------AAAG-----------DAP---------------APQQQ--------------QEQRH----------
SEQIDNO:211   MVGSDG--------------DGDGGGGEAHAP--------AAPAHHHRRPPRP-----------RGGSGAIVEG----FAAALRRRIRSGAAAARASFGG---DSGDEAASGEPSSSSSPSRRRG
SEQIDNO:212   MTIPEL--------------PESLETTTLNSHHS------RAASTVRRRSIDV----------AV-ESDSNSLEA---VNDSDS-DVNNFNEMGNLRGGVVE------SALEEPSELCTEGLR------NG
SEQIDNO:213   MAISDT--------------PETTATATATVTTTETDTDLKRSSLRRRPSAT-----------STAGGLF--------D------AFSAAADAVRDSGS---------------DDSINGKIVNFF----FV
SEQIDNO:214   MAISED--------------SESLFAAAAASS--------VIQSGSSVRRRPSAL----------SAVATVE------DE------SSSEEPVPVRDSGSD--------------VDJSVS--SEQF----VS
SEQIDNO:215   MTILET--TT-SGGDGVAES-SS-----------------D-NVSLRRRRRKGT-----------SSDGALP------ELTS-NIVELESESGG-QVMMDPGM--VTEPETEKING--KDCG---------GD
SEQIDNO:216   ----------------------MANNINE-AS--------D-NFSLRRR-TGG-----------ISSTTVP------DSSS-ETSSSEADYLD--GGKGAAD--VKDRGDGAVEF--QNSM----------KN
SEQIDNO:217   MEILDS--------------GGVTMPIENGG---------ADLDTLRHRKPRS----------DSSNGLLIF------DSVT-VSD---ADVRDRVDSAV--------------EDTQGKANLAGENEI---R
SEQIDNO:218   MAILDS--------------GGVAVPPTENG---------VADLDRLHRRKSRS---------DSSNGLLIS------DTS-PSDDVGAAAAERDRVDSAAE---------------EEAQGTANLAGDAE----T
SEQIDNO:219   MAILDS--------------AGVTVTIENGGGE-------FVDLDRLRRRKSRS----------DSSNGLLIS-----GSDNNS-PSDDVGAPDVRDRIDSVVN----DDAQGTANLAGDNNG-------G
SEQIDNO:220   MAPPPSMP--A--ASDRAGPGRDAG---------------DSSSLRLRRAPS----------ADAGDLAG--------DSSG-GLRENG-EPQSP--------------------TNPPP----------G
SEQIDNO:221   MAILDS--------------GGVAVPPTENG---------VADLDRLHRRKSSS---------DSSNGLLIS------DTS-PSDDVGAAAAERDRVDSAAE---------------EEAQGTANLAGDAE----T
SEQIDNO:222   ----------------------------------------------------------------------------------------------------------------------------------
```

FIGURE 5B

```
Majority      NEQXQN------ -EN--------TD----                                 VKFX YRPSVP AHRR VKES PLSSDAI F KQSHAGLFNLCIVVL AVN---------SRLI
SEQIDNO:12    TNGNDG------GEKIANGEDRRTDFAA-----                              VKLA YRPSVP AHRR IKES PLSSDAI F KQSHAGLFNLCIVVL AVN---------SRLI
SEQIDNO:153   NSQQQN------EKQ--------DTDFSV-----                             LKFA YRPSVP AHRK VKES PLSSDTI F KQSHAGLFNLCIVVL AVN---------SRLI
SEQIDNO:195   NSQQQN------EKQ--------DTDFSV-----                             LKFA YRPSVP AHRK VKES PLSSDTI F KQSHAGLFNLCIVVL AVN---------SRLI
SEQIDNO:16    NSQQQN------EKQ--------DTDFSV-----                             LKFA YRPSVP AHRK VKES PLSSDTI F KQSHAGLFNLCIVVL AVN---------SRLI
SEQIDNO:196   NSQPQ-------QKQ--------DTDFSV-----                             LKFA YRPSVP AHRK VKES PLSSDTI F KQSHAGLFNLCIVVL AVN---------SRLI
SEQIDNO:197   NSQPQ-------QKQ--------DTDFSV-----                             LKFA YRPSVP AHRK VKFS PLSSDTT F KQSFAGIFNLCTVVL AVN---------SRI.I
SEQIDNO:198   NSQQQN------EKQ--------DTDFSV-----                             LKFA YRPSVP AHRK VKES PLSSDTI F KQSHAGLFNLCIVVL AVN---------SRLI
SEQIDNO:199   QEQQQ-------------------H---------                             EMLY YRASAP AHRRA RES PLSSDAI F KQSHAGLFNLCVVVL IAVNSRLIIENLMKSHAGLFNLCVVVLIAVNSRLI
SEQIDNO:200   GDNNGGRGGGEGRG----NAD-----                                     ATFT YRPSVP AHRRA RES PLSSDAI F KQSHAGLFNLCVVVL IAVN---------SRLI
SEQIDNO:201   RNGENG------VAEVA-----                                         AKFA YRPCAP AHRK VKES PLSSDAI F KQSHAGLFNLCIVVL AVN---------SRLI
SEQIDNO:202   RNGENG------VAEVA-----                                         AKFA YRPCAP AHRK IKES PLSSDAI F KQSHAGLFNLCIVVL AVN---------SRLI
SEQIDNO:203   DESK--------KGNG------                           VKKGRETTVVHYA ARPSS PAHRR VRES PLSSDAI F KQSHAGLFNLCIVVL AVN---------GRLI
SEQIDNO:204   DESKDD------SKGNGQ----                           VKKGRETTVVHYA VRPSS PAHRR IKES PLSSDAI F KQSHAGLFNLCIVVL AVN---------GRLI
SEQIDNO:205   KDRIEN------RENRG-----GSD----                                  VKFT YRPSVP AHRAL KES PLSSDNI F KQSHAGLFNLCIVVL AVN---------SRLI
SEQIDNO:206   VIGNEE------KQ-VG-----ETD----                                  IRFT YRPSFP AHRR VRES PLSSDAI F KQSHAGLFNLCIVVL AVN---------SRLI
SEQIDNO:207   -DKVTN------ENR-------SD-----                                  IKFN YRPSMP AHRC MRES PLSSDAT F KQSHAGI FNLCTVVL AIN---------SRI.T
SEQIDNO:208   AKVKFNGFTSNGNG---------TDVMA-                                  FSAFT FRAAP AHRE VHRK NKFS PLSSDAT F KGSHAGT FNL CTVVI.TAVN---------SRI.T
SEQIDNO:209   GDSNGAEASSAAGGGGRGGGGD-----                                    FSAFT ERAAA VHRK AKES PLSSGNI F KQSHAGLFNLCIVVL AVN---------SRLI
SEQIDNO:210   QEQQQ------------------                                        QLLW YRASA PAHRK SKES PLSSGNI F KQSHAGLFNLCIVVL AVN---------SRLI
SEQIDNO:211   GDSNGAEASSAAGGGGRGGGGD-MEVLAS--                                AKFA HRPSAP VHRR VHRR IKES PLSSDAI F KQSHAGLFNLCVVVL AVN---------SRLI
SEQIDNO:212   KEENEHVRTGESNQE----                                            TKFA YRPSAP AHRAL RES PLSSDAI F RH-HAGLFNLCIVVL AVN---------SRLI
SEQIDNO:213   KDRKTD------HAEGI-VDDDDNAVKKNGGNDVINDRENVAVDFKFT               IKFT YRPSVP AHRT IKES PLSSDAI F KQSHAGLFNLCIVVL AVN---------SRLI
SEQIDNO:214   PATANR------EKN-------QVHDISA-                                 SRFT YRPSVP AHRT VRES PLSSDAI F KQSHAGLFNLCIVVL AVN---------SRLI
SEQIDNO:215   KDKIDN------RENRG-----RSD----                                  VRYT YRPSVP AHRR TRES PLSSDAI F KQSHAGLFNLCVVVL AVN---------SRLI
SEQIDNO:216   VERIEK------HESRV-----GLD----                                  ATFT YRPSVP AHRRA RES PLSSDAI F KQSHAGLFNLCIVVL IAVN---------SRPI
SEQIDNO:217   --ESG-------GEAGG-----NVD----                                  EMLY YRASAP AHRK VKES PLSSDAI F KQSHAGL NLCIVVL IAVN---------SRLI
SEQIDNO:218   RESAGG------D--------                                          VRFT YRPSVP AHRR VKES PLSSDAI F KQSHAGLFNLCVVVL AVN---------SRLI
SEQIDNO:219   GDNNGGRGGGEGRG-----                                            
SEQIDNO:220   QEQQQ-------H--------                                          
SEQIDNO:221   RESAGG------D--------                                          
SEQIDNO:222   --------------------                                           
```

```
Majority      MCVLLYYHDLMNR-KGKXX----

SEQIDNO:12    MCVLLYYHDLMNR-KGKTE     540
SEQIDNO:153   MCVLLYYHDLMNR-KGKLD     504
SEQIDNO:195   MCVLLYYHDLMNR-KGKLD     504
SEQIDNO:16    MCVLLYYHDLMNR-KGKLD     504
SEQIDNO:196   MCVLLYYHDLMNR-KGKLD     498
SEQIDNO:197   MCVLLYYHDLMNR-KGKLD     498
SEQIDNO:198   MCVLLYYHDLMNR-KGKLD     504
SEQIDNO:199   MCVLLYYHDVMNR-QAQASR    494
SEQIDNO:200   MCVLLYYHDLMNR-KGSMS     547
SEQIDNO:201   MCVLLYYHDLMNR-KETTESSL  518
SEQIDNO:202   MCVLLYYHDLMNR-KETTXSSL  502
SEQIDNO:203   MCVFLYYHEVN-Q-KGKSK     517
SEQIDNO:204   MCVLLYYHDVMNQ-KGKSK     523
SEQIDNO:205   MCLLLYYHDLMNR-KGTTESR   526
SEQIDNO:206   MCVLLYYHDLINL-KEK       518
SEQIDNO:207   MCVLLYYHDLMNR-K         446
SEQIDNO:208   MCVLLYYHDLMNR-KASAR     534
SEQIDNO:209   MCLLLYYHDVMNR-IEKAR     538
SEQIDNO:210   MCVLLYYHDVMNRQAQTNR     477
SEQIDNO:211   MCLLLYYHDVMNR-IEKAR     504
SEQIDNO:212   MCLLLYYHDLMNR-KASAK     532
SEQIDNO:213   MCVLLYYHDLMNR-KGEID     539
SEQIDNO:214   MAVLLYYHDLMNR-KSKLDQS   511
SEQIDNO:215   MCVLLYYHDLMNR-KGNAELR   521
SEQIDNO:216   MCLLLYYHDLMNR-NGKME     507
SEQIDNO:217   MCVLLYYHDLMNR-KGKMS     501
SEQIDNO:218   MCVLLYYHDLMNR-KGSMS     503
SEQIDNO:219   MCVLLYYHDLMNR-KGSMS     520
SEQIDNO:220   MCVLLYYHDVMNR-QAQASR    494
SEQIDNO:221   MCGLLYYHDLMNR-KGSMS     503
SEQIDNO:222   MCGLLYYHDLMNR-KGSMS     341
```

DGAT GENES FOR INCREASED SEED STORAGE LIPID PRODUCTION AND ALTERED FATTY ACID PROFILES IN OILSEED PLANTS

This application claims the benefit of U.S. Provisional Application No. 61/055,579, filed May 23, 2008, the contents of which are hereby incorporated by reference.

FIELD OF THE INVENTION

This invention is in the field of biotechnology, in particular, this pertains to polynucleotide sequences encoding diacylglycerol acyltransferase genes and the use of these acyltransferases for increased seed storage lipid production and altered fatty acid profiles in oilseed plants.

BACKGROUND OF THE INVENTION

Plant oil is a valuable renewable resource, with annual world production of 145 million metric tons valued at over 80 billion U.S. dollars (Rupilius and Ahmad, 2007, Eur J Lipid Sci Technol 109:433-439). Methods to increase the content, and to improve the composition of plant oils are therefore desired. Plant lipids have a variety of industrial and nutritional uses and are central to plant membrane function and climatic adaptation. These lipids represent a vast array of chemical structures, and these structures determine the physiological and industrial properties of the lipid. Many of these structures result either directly or indirectly from metabolic processes that alter the degree of unsaturation of the lipid. Different metabolic regimes in different plants produce these altered lipids, and either domestication of exotic plant species or modification of agronomically adapted species is usually required to produce economically large amounts of the desired lipid.

There are limitations to using conventional plant breeding to alter fatty acid composition and content. Plant breeding will rarely uncover mutations that a) result in a dominant ("gain-of-function") phenotype, b) that do not have negative pleiotropic effects on growth or agronomic properties, and c) that are in an enzyme that exerts primary control over fatty acid levels of composition. In cases where desired phenotypes are available in mutant corn lines, their introgression into elite lines by traditional breeding techniques is slow and expensive, since the desired oil compositions are likely the result of several recessive genes.

Recent molecular and cellular biology techniques offer the potential for overcoming some of the limitations of the conventional breeding approach. Some of the particularly useful technologies are seed-specific expression of foreign genes in transgenic plants [see Goldberg et al (1989) Cell 56:149-160], and the use of antisense RNA to inhibit plant target genes in a dominant and tissue-specific manner [see van der Krol et al (1988) Gene 72:45-50]. Other advances include the transfer of foreign genes into elite commercial varieties of commercial oilcrops, such as soybean [Chee et al (1989) Plant Physiol. 91:1212-1218; Christou et al (1989) Proc. Natl. Acad. Sci. U.S.A. 86:7500-7504; Hinchee et al (1988) Bio/Technology 6:915-922; EPO publication 0 301 749 A2], rapeseed [De Block et al (1989) Plant Physiol. 91:694-701], and sunflower [Everett et al (1987) Bio/Technology 5:1201-1204], and the use of genes as restriction fragment length polymorphism (RFLP) markers in a breeding program, which makes introgression of recessive traits into elite lines rapid and less expensive [Tanksley et al (1989) Bio/Technology 7:257-264]. However, application of each of these technologies requires identification and isolation of commercially-important genes.

Most free fatty acids become esterified to coenzyme A (CoA), to yield acyl-CoAs. These molecules are then substrates for glycerolipid synthesis in the endoplasmic reticulum of the cell, where phosphatidic acid and diacylglycerol (DAG) are produced. Either of these metabolic intermediates may be directed to membrane phospholipids (e.g., phosphatidylglycerol, phosphatidylethanolamine, phosphatidylcholine) or DAG may be directed to form triacylglycerols (TAGs), the primary storage reserve of lipids in eukaryotic cells.

Diacylglycerol acyltransferase ("DGAT") is an integral membrane protein that catalyzes the final enzymatic step in the production of triacylglycerols in plants, fungi and mammals. This enzyme is responsible for transferring an acyl group from acyl-coenzyme-A to the sn-3 position of 1,2-diacylglycerol ("DAG") to form triacylglycerol ("TAG"). DGAT is associated with membrane and lipid body fractions in plants and fungi, particularly, in oilseeds where it contributes to the storage of carbon used as energy reserves. TAG is believed to be an important chemical for storage of energy in cells. DGAT is known to regulate TAG structure and to direct TAG synthesis. Furthermore, it is known that the DGAT reaction is specific for oil synthesis.

TAG is the primary component of vegetable oil in plants, It is used by the seed as a stored form of energy to be used during seed germination.

Two different families of DGAT proteins have been identified. The first family of DGAT proteins ("DGAT1") is related to the acyl-coenzyme A:cholesterol acyltransferase ("ACAT") and has been described in U.S. Pat. Nos. 6,100,077 and 6,344,548. A second family of DGAT proteins ("DGAT2") is unrelated to the DGAT1 family and is described in PCT Patent Publication WO 2004/011671 published Feb. 5, 2004. Other references to DGAT genes and their use in plants include PCT Publication Nos. WO2004/011, 671, WO1998/055,631, and WO2000/001,713, and US Patent Publication No. 20030115632.

Applicants' Assignee's copending published patent application US 2006-0094088 describes genes for DGATs of plants and fungi and their use is in modifying levels of polyunsaturated fatty acids ("PUFAs") in edible oils.

Applicants' Assignee's published PCT application WO 2005/003322 describes the cloning of phosphatidylcholine diacylglycerol acyltransferase and DGAT2 for altering PUFA and oil content in oleaginous yeast.

SUMMARY OF THE INVENTION

The present invention concerns a transgenic soybean seed having increased total fatty acid content of at least 10% when compared to the total fatty acid content of a null segregant soybean seed.

In a second embodiment, the present invention concerns a method for increasing the total fatty acid content of a soybean seed comprising:

(a) transforming at least one soybean cell with one or more recombinant constructs having at least one novel DGAT sequence;

(b) selecting the transformed soybean cell(s) of step (a) having an increased total fatty acid content of at least 10% when compared to the total fatty acid content of a null segregant soybean seed.

In a third embodiment, the present invention concerns a transgenic corn kernel having increased total fatty acid content of at least 10% when compared to the total fatty acid content of a null segregant corn kernel.

In a fourth embodiment, the present invention concerns a method for increasing the total fatty acid content of a corn kernel comprising:

(a) transforming at least one corn kernel with one or more recombinant constructs having at least one novel DGAT sequence;

(b) selecting the transformed corn kernel(s) of step (a) having an increased total fatty acid content of at least 10% when compared to the total fatty acid content of a null segregant corn kernel.

In a fifth embodiment, the present invention concerns a transgenic soybean seed having increased total fatty acid content of at least 10% and an increased oleic acid content of at least 25% when compared to the total fatty acid content and oleic acid content of a null segregant soybean seed.

In a further embodiment, the present invention concerns a transgenic soybean having increased total fatty acid content of at least 10% and at least any one of i) an increased oleic acid content of at least 25%; ii) a decreased linolenic acid content of at least 25%; iii) a decreased linoleic acid content of at least 4%; iv) a decreased palmitic acid content of at lease 8%; and v) an increased stearic acid content of at lease 14% when compared to the total fatty acid content and oleic, linolenic acid, linoelic acid, palmitic acid or stearic acid, respectively, content of a null segregant soybean seed.

In an sixth embodiment, the present invention concerns a method for increasing the total fatty acid content and oleic acid content of a soybean seed comprising:

(a) transforming at least one soybean cell with one or more recombinant constructs having at least one novel DGAT sequence;

(b) selecting the transformed soybean cell(s) of step (a) having an increased total fatty acid content of at least 10% and an increased oleic acid content of at least 25% when compared to the total fatty acid content and oleic acid content of a null segregant soybean seed.

In a seventh embodiment, the present invention concerns a method for increasing the total fatty acid content and decreasing linolenic acid content of a soybean seed comprising:

(a) transforming at least one soybean cell with one or more recombinant constructs having at least one novel DGAT sequence;

(b) selecting the transformed soybean cell(s) of step (a) having an increased total fatty acid content of at least 10% and a decreased linolenic acid content of at least 25% when compared to the total fatty acid content and oleic acid content of a null segregant soybean seed.

In an eighth embodiment, the present invention concerns a method for increasing the total fatty acid content and decreasing linoleic acid content of a soybean seed comprising:

(a) transforming at least one soybean cell with one or more recombinant constructs having at least one novel DGAT sequence;

(b) selecting the transformed soybean cell(s) of step (a) having an increased total fatty acid content of at least 10% and a decreased linoleic acid content of at least 4% when compared to the total fatty acid content and oleic acid content of a null segregant soybean seed.

In a ninth embodiment, the present invention concerns a method for increasing the total fatty acid content and decreased palmitic acid content of a soybean seed comprising:

(a) transforming at least one soybean cell with one or more recombinant constructs having at least one novel DGAT sequence;

(b) selecting the transformed soybean cell(s) of step (a) having an increased total fatty acid content of at least 10% and a decreased palmitic acid content of at least 8% when compared to the total fatty acid content and oleic acid content of a null segregant soybean seed.

In a tenth embodiment, the present invention concerns a method for increasing the total fatty acid content and stearic acid content of a soybean seed comprising:

(a) transforming at least one soybean cell with one or more recombinant constructs having at least one novel DGAT sequence;

(b) selecting the transformed soybean cell(s) of step (a) having an increased total fatty acid content of at least 10% and an increased stearic acid content of at least 14% when compared to the total fatty acid content and oleic acid content of a null segregant soybean seed.

Any of the transgenic seed of the invention may comprise a recombinant construct having at least one DGAT sequence which can be selected from the group consisting of DGAT1, DGAT2 and DGAT1 in combination with DGAT2. Furthermore, the DGAT sequence can be a tree nut or shuffled DGAT sequence. Furthermore, the DGAT sequence can contain amino acid substitutions that result in greater oil increases than are achieved with the non-substituted sequence.

In an eleventh embodiment the present invention concerns an isolated polynucleotide comprising:

(a) a nucleotide sequence encoding a polypeptide having diacylglycerol acyltransferase activity wherein the polypeptide has at least 80% amino acid identity, based on the Clustal V method of alignment, when compared to an amino acid sequence as set forth in SEQ ID NOs: 8, 10, or 12;

(b) a nucleotide sequence encoding a polypeptide having diacylglycerol acyltransferase activity, wherein the nucleotide sequence has at least 80%, 85%, 90%, 95%, or 100% sequence identity, based on the BLASTN method of alignment, when compared to a nucleotide sequence as set forth in SEQ ID NO: 7, 9, or 11:

(c) a nucleotide sequence encoding a polypeptide having diacylglycerol acyltransferase activity, wherein the nucleotide sequence hybridizes under stringent conditions to a nucleotide sequence as set forth in SEQ ID NO: 7, 9, or 11; or (d) a complement of the nucleotide sequence of (a), (b) or (c), wherein the complement and the nucleotide sequence consist of the same number of nucleotides and are 100% complementary.

The isolated polynucleotide may be obtained from one or more edible nuts, such as, but not limited to, hazelnut, hickory, pistachio, and pecan. The isolated polynucleotide may also be part of a recombinant DNA construct comprising at least one regulatory sequence. This recombinant construct may also be comprised in a cell. This cell may be from an oilseed plant. Suitable oilseed plants include, but are not limited to, soybean, corn, canola, sunflower, flax, cotton, and safflower.

In a twelfth embodiment the present invention concerns a method for increasing the total fatty acid content of an oilseed comprising:

(a) transforming at least one oilseed cell with the above mentioned recombinant construct;

(b) selecting the transformed oilseed cell(s) of step (a) having an increased total fatty acid content when compared to the total fatty acid content of a null segregant oilseed.

Also within the scope of the invention are product(s) and/or by-product(s) obtained from the transgenic soybean seeds of the invention.

In another aspect this invention concerns an isolated nucleic acid fragment encoding a modified Type 1 diacylglycerol acyltransferase polypeptide such that the modified Type 1 diacylglycerol acyltransferase polypeptide has at least one amino acid substitution selected from the group consisting of:

a non-alanine at a position corresponding to position 12 of SEQ ID NO:12 to alanine,
a non-proline at a position corresponding to position 30 of SEQ ID NO:12 to proline,
a non-alanine at a position corresponding to position 31 of SEQ ID NO:12 to alanine,
a non-serine at a position corresponding to position 48 of SEQ ID NO:12 to serine,
a non-serine at a position corresponding to position 49 of SEQ ID NO:12 to serine,
a non-aspartate at a position corresponding to position 51 of SEQ ID NO:12 to aspartate,
a non-aspartate at a position corresponding to position 52 of SEQ ID NO:12 to aspartate,
a non-threonine at a position corresponding to position 59 of SEQ ID NO:12 to threonine,
a non-threonine at a position corresponding to position 73 of SEQ ID NO:12 to threonine,
a non-asparagine at a position corresponding to position 79 of SEQ ID NO:12 to asparagine,
a non-leucine at a position corresponding to position 118 of SEQ ID NO:12 to leucine,
a non-alanine at a position corresponding to position 123 of SEQ ID NO:12 to alanine,
a non-valine at a position corresponding to position 128 of SEQ ID NO:12 to valine,
a non-leucine at a position corresponding to position 139 of SEQ ID NO:12 to leucine,
a non-isoleucine at a position corresponding to position 155 of SEQ ID NO:12 to isoleucine,
a non-alanine at a position corresponding to position 181 of SEQ ID NO:12 to alanine,
a non-serine at a position corresponding to position 184 of SEQ ID NO:12 to serine,
a non-valine at a position corresponding to position 197 of SEQ ID NO:12 to valine,
a non-valine at a position corresponding to position 198 of SEQ ID NO:12 to valine,
a non-methionine at a position corresponding to position 205 of SEQ ID NO:12 to methionine,
a non-threonine at a position corresponding to position 211 of SEQ ID NO:12 to threonine,
a non-histidine at a position corresponding to position 218 of SEQ ID NO:12 to histidine,
a non-valine at a position corresponding to position 222 of SEQ ID NO:12 to valine,
a non-lysine at a position corresponding to position 241 of SEQ ID NO:12 to lysine,
a non-valine at a position corresponding to position 247 of SEQ ID NO:12 to valine,
a non-valine at a position corresponding to position 251 of SEQ ID NO:12 to valine,
a non-serine at a position corresponding to position 256 of SEQ ID NO:12 to serine,
a non-serine at a position corresponding to position 257 of SEQ ID NO:12 to serine,
a non-phenylalanine at a position corresponding to position 266 of SEQ ID NO:12 to phenylalanine,
a non-alanine at a position corresponding to position 267 of SEQ ID NO:12 to alanine,
a non-glutamate at a position corresponding to position 281 of SEQ ID NO:12 to glutamate,
a non-aspartate at a position corresponding to position 288 of SEQ ID NO:12 to aspartate,
a non-glutamate at a position corresponding to position 293 of SEQ ID NO:12 to glutamate,
a non-asparagine at a position corresponding to position 294 of SEQ ID NO:12 to asparagine,
a non-threonine at a position corresponding to position 299 of SEQ ID NO:12 to threonine,
a non-asparagine at a position corresponding to position 301 of SEQ ID NO:12 to asparagine,
a non-leucine at a position corresponding to position 308 of SEQ ID NO:12 to leucine,
a non-glycine at a position corresponding to position 327 of SEQ ID NO:12 to glycine,
a non-leucine at a position corresponding to position 329 of SEQ ID NO:12 to leucine,
a non-leucine at a position corresponding to position 334 of SEQ ID NO:12 to leucine,
a non-valine at a position corresponding to position 337 of SEQ ID NO:12 to valine,
a non-valine at a position corresponding to position 338 of SEQ ID NO:12 to valine,
a non-glutamine at a position corresponding to position 356 of SEQ ID NO:12 to glutamine,
a non-asparagine at a position corresponding to position 363 of SEQ ID NO:12 to asparagine,
a non-serine at a position corresponding to position 390 of SEQ ID NO:12 to serine,
a non-valine at a position corresponding to position 399 of SEQ ID NO:12 to valine,
a non-isoleucine at a position corresponding to position 436 of SEQ ID NO:12 to isoleucine,
a non-alanine at a position corresponding to position 451 of SEQ ID NO:12 to alanine,
a non-serine at a position corresponding to position 457 of SEQ ID NO:12 to serine,
a non-methionine at a position corresponding to position 475 of SEQ ID NO:12 to methionine,
a non-phenylalanine at a position corresponding to position 486 of SEQ ID NO:12 to phenylalanine,
a non-isoleucine at a position corresponding to position 488 of SEQ ID NO:12 to isoleucine,
a non-leucine at a position corresponding to position 491 of SEQ ID NO:12 to leucine,
a non-lysine at a position corresponding to position 502 of SEQ ID NO:12 to lysine,
a non-serine at a position corresponding to position 514 of SEQ ID NO:12 to serine,
a non-valine at a position corresponding to position 518 of SEQ ID NO:12 to valine, and
a non-valine at a position corresponding to position 531 of SEQ ID NO:12 to valine,
when compared to the unmodified Type 1 diacylglycerol acyltransferase polypeptide, wherein the position corresponding to a position of SEQ ID NO:12 is based on an alignment using Clustal V of SEQ ID NO:12 and the unmodified Type 1 diacylglycerol acyltransferase polypeptide.

This invention further concerns an isolated nucleic acid fragment encoding a modified Type 1 diacylglycerol acyltransferase polypeptide such that the modified Type 1 diacylglycerol acyltransferase polypeptide has at least one amino acid substitution selected from the group consisting of:

a non-alanine at a position corresponding to position 24 of SEQ ID NO:153 to alanine,
a non-asparagine at a position corresponding to position 58 of SEQ ID NO:153 to asparagine, a non-alanine at a position corresponding to position 146 of SEQ ID NO:153 to alanine, a non-methionine at a position corresponding to position 170 of SEQ ID NO:153 to methionine, a non-lysine at a position corresponding to position 206 of SEQ ID NO:153 to lysine, a non-valine at a position corresponding to position 216 of SEQ ID NO:153 to valine, a non-phenylalanine at a position corresponding to position 231 of SEQ ID NO:153 to phenylalanine, a non-glutamate at a position corresponding to position 258 of SEQ ID NO:153 to glutamate, a non-threonine at a position corresponding to position 264 of SEQ ID NO:153 to threonine, a non-leucine at a position corresponding to position 273 of SEQ ID NO:153 to leucine, a non-leucine at a position corresponding to position 299 of SEQ ID NO:153 to leucine, a non-valine at a position corresponding to position 303 of SEQ ID NO:153 to valine, a non-serine at a position corresponding to position 355 of SEQ ID NO:153 to serine, a non-valine at a position corresponding to position 364 of SEQ ID NO:153 to valine, a non-arginine at a position corresponding to position 401 of SEQ ID NO:153 to arginine, a non-serine at a position corresponding to position 422 of SEQ ID NO:153 to serine, a non-methionine at a position corresponding to position 440 of SEQ ID NO:153 to methionine, a non-lysine at a position corresponding to position 467 of SEQ ID NO:153 to lysine, a non-serine at a position corresponding to position 479 of SEQ ID NO:153 to serine, a non-valine at a position corresponding to position 483 of SEQ ID NO:153 to valine, when compared to the unmodified Type 1 diacylglycerol acyltransferase polypeptide, wherein the position corresponding to a position of SEQ ID NO:153 is based on an alignment using Clustal V of SEQ ID NO:153 and the unmodified Type 1 diacylglycerol acyltransferase polypeptide.

The above mentioned isolated nucleic acids can be further used in methods to increase fatty acid content of an oilseed by: 1) incorporating the isolated nucleic acid inot a recombinant DNA construct comprising at least one regulatory element, 2) introducing the recombinant DNA construct into an oilseed cell, and selecting transgenic cells that have increased fatty acid content when compared to non-transgenic null segregants. Plants produced by this method, and plants that incorporate the recombinant DNA construct of the invention, are also claimed, as are the progeny of those plants. Furthermore, by-product and oil products produced from these plants are also claimed.

In a final embodiment the present invention concerns fungi, or microbial oleaginous organisms, comprising a recombinant DNA construct comprising any isolated nucleic acid fragments encoding any diacylglycerol acyltransferase of the present invention. Further, the fungal cell can be, but is not limited to, *Yarrowia, Candida, Rhodotorula, Rhodosporidium, Cryptococcus, Trichosporon* and *Lipomyces*.

BRIEF DESCRIPTION OF THE DRAWINGS AND SEQUENCE LISTINGS

The invention can be more fully understood from the following detailed description and the accompanying drawings and Sequence Listing, which form a part of this application.

FIG. 1 provides plasmid map for yeast expression vector pSZ378.

Figure 2:
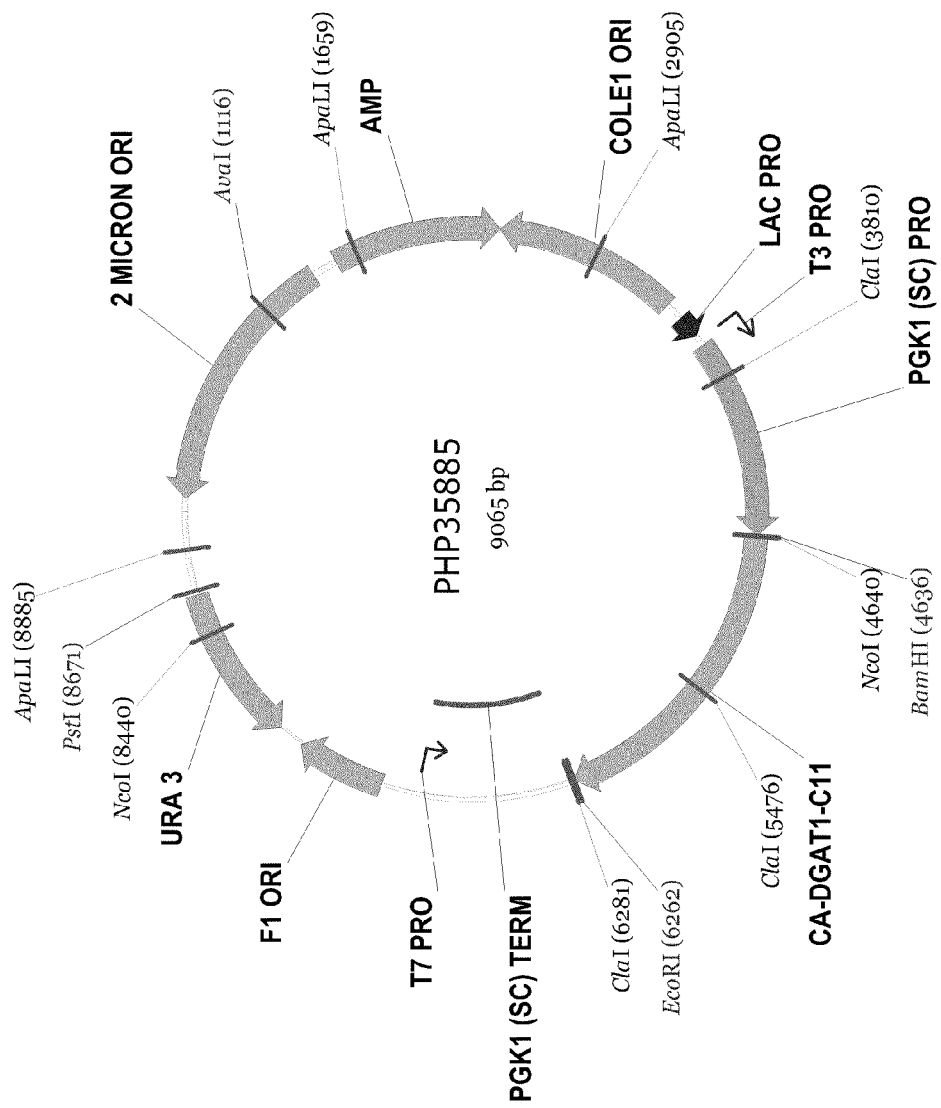

FIG. 2 provides plasmid map for PHP35885, comprising novel DGAT CA-DGAT1-C11 in yeast expression vector.

Figure 3:
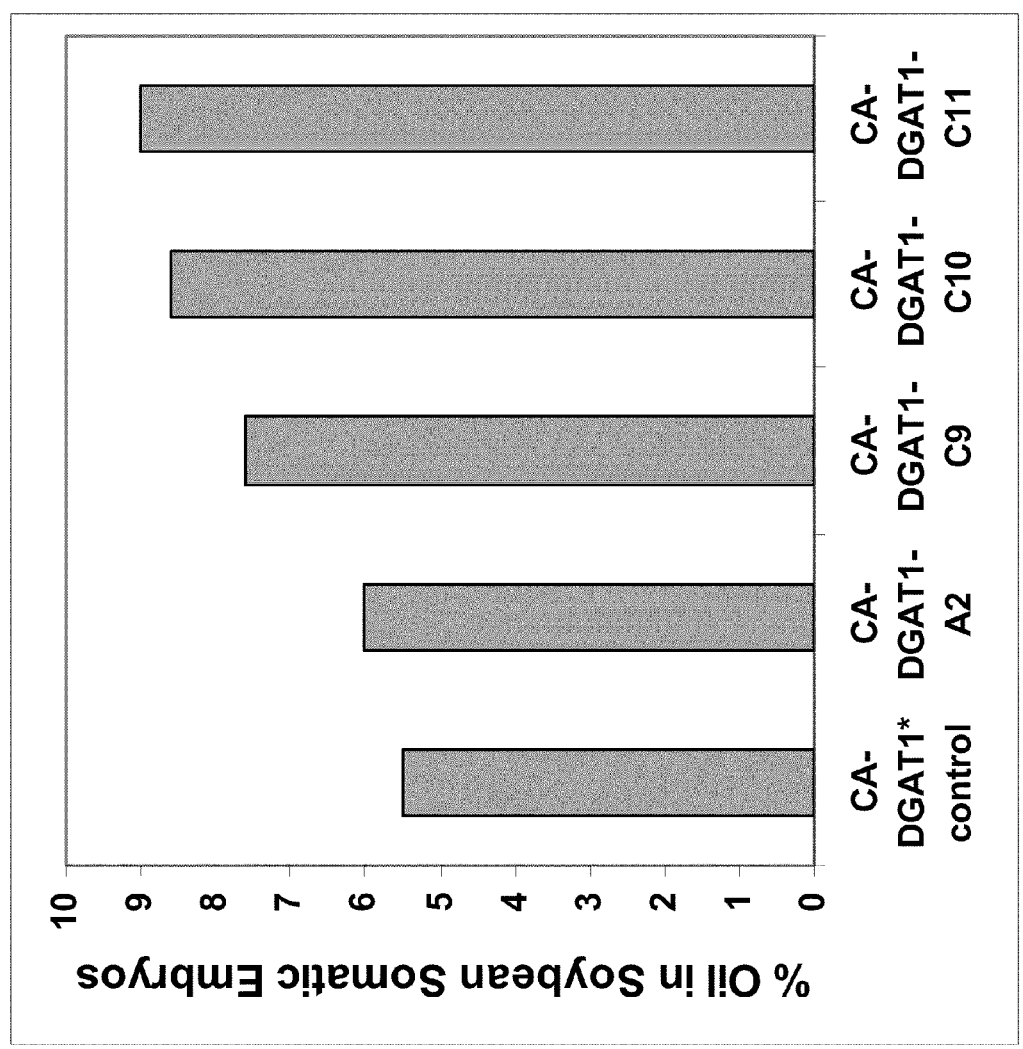

FIG. 3 provides oil content of soybean somatic embryos transformed with the hazelnut DGAT gene or with four novel DGAT genes.

Figure 4:
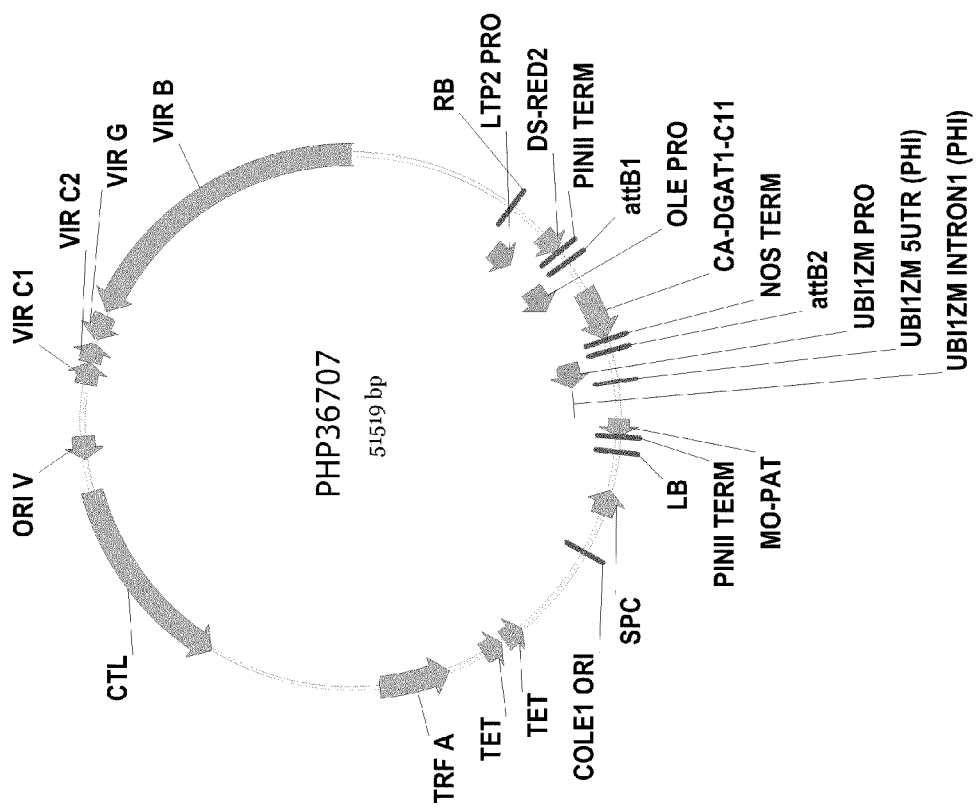

FIG. 4 provides plasmid map for PHP36707, comprising novel DGAT CA-DGAT1-C11 in maize transformation vector.

Figure 5C:
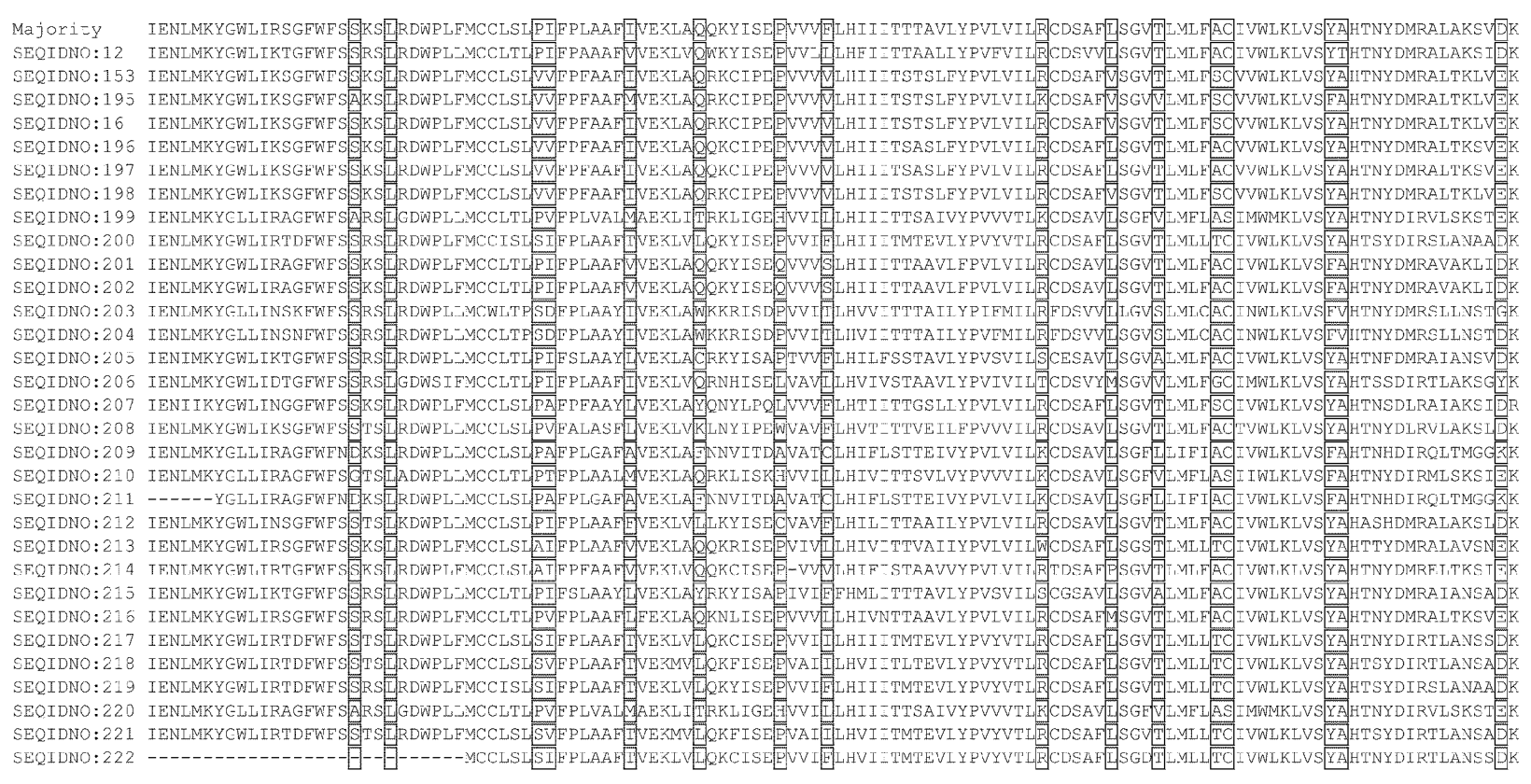
Figure 5D:
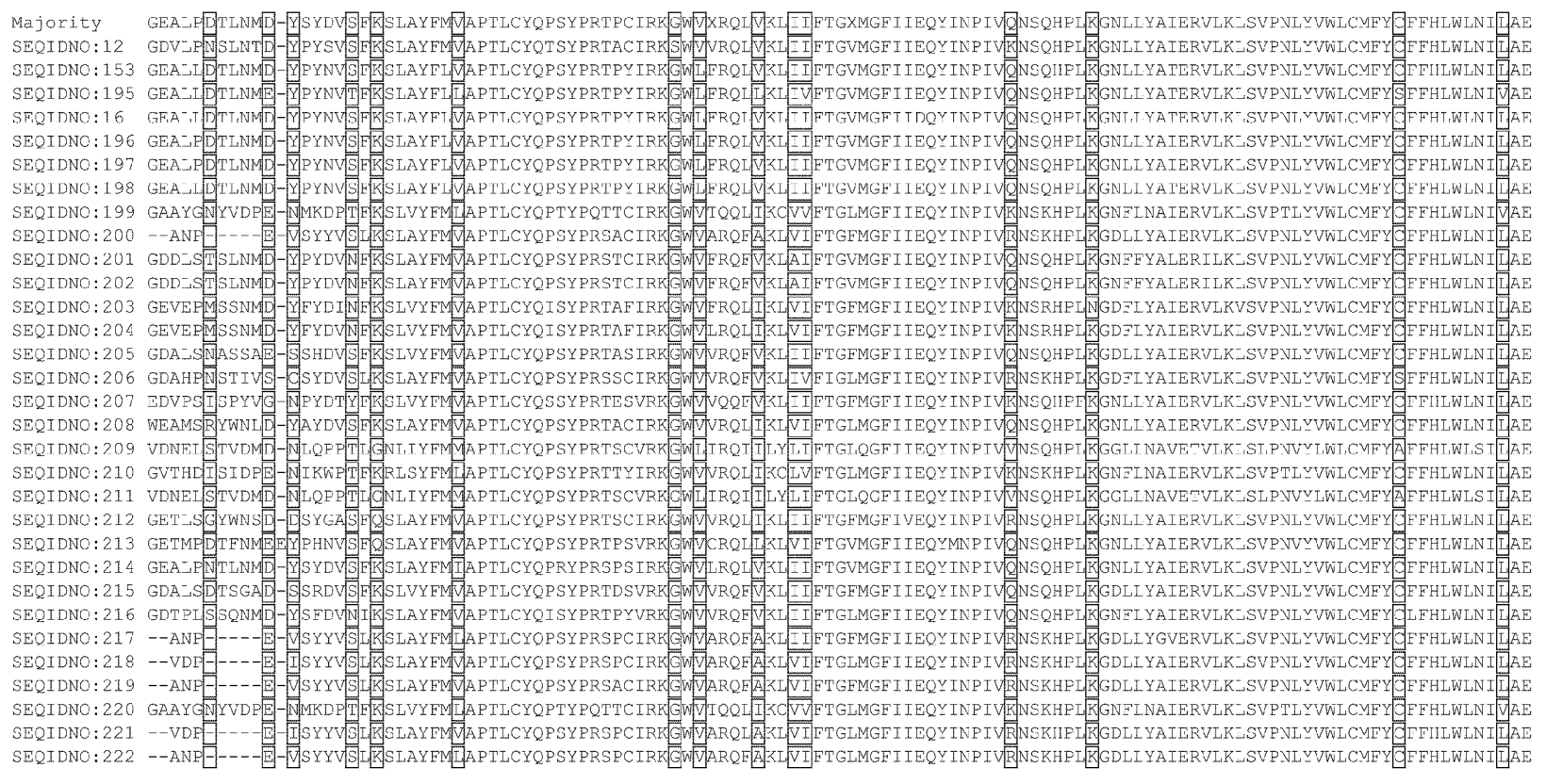
Figure 5E:
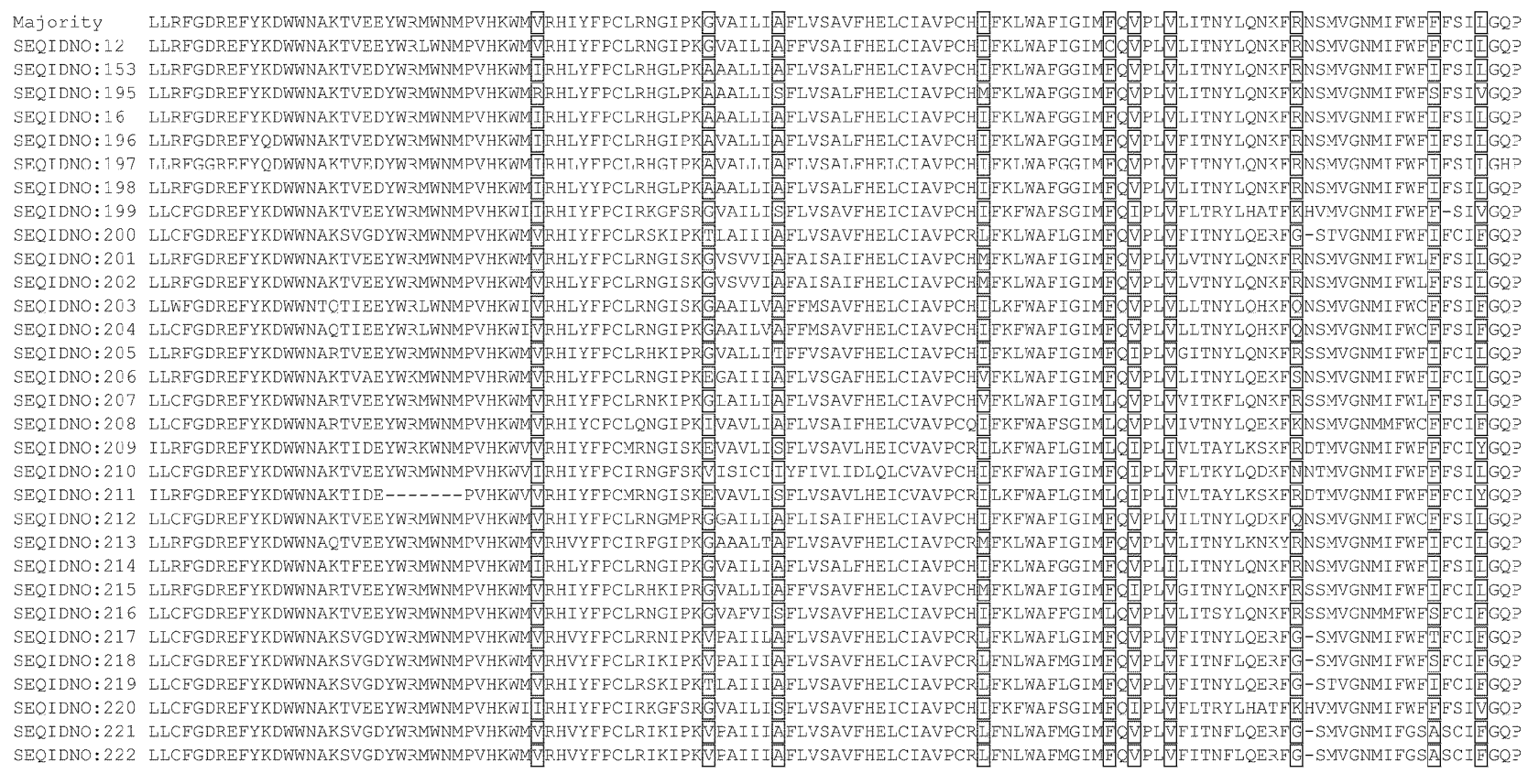

FIG. 5 A-F provides the Clustal V alignment of 31 plant DGAT1 sequences. Certain amino acid substitution positions that give rise to higher oil content in yeast and plants are boxed. Sequences aligned include hazelnut DGAT1 (SEQ ID NO:12); soybean DGAT1 (SEQ ID NO:153); a soybean shuffled (Jall Call) DGAT1 (SEQ ID NO:195); soybean DGAT1 (SEQ ID NO:16); soybean (*Glycine max*) GmDGAT1 (gi56199782, SEQ ID NO:196); soybean (*Glycine max*) GmDGAT1a (gi93204650 SEQ ID NO:197); soybean (*Glycine max*) GmDGAT1b (gi93204652, SEQ ID NO:198); maize (*Zea mays*) ZM-DGAT1 (gi/87806722, SEQ ID NO:199); *Arabidopsis thaliana* DGAT1 (gi91152592, SEQ ID NO:200); grape (*Vitis vinifora*) DGAT1 (gi225444869, SEQ ID NO:201); grape (*Vitis vinifora*) DGAT1 (gi147859067, SEQ ID NO:202); *Vernonia galamensis*_DGAT1 (gi157092192, SEQ ID NO:203); *Vernonia galamensis* DGAT1 (gi157092190, SEQ ID NO:204); tung oil tree (*Vernicia fordii*) DGAT1 (gi86279632, SEQ ID NO:205); nasturtium *Tropaeolum majus* DGAT1 (gi67043496, SEQ ID NO:206); black cottonwood *Populus trichcarpa*_DGAT1 (gi224087975, SEQ ID NO:207); beefsteak (*Perilla frutescens*) DGAT1 gi10803053, SEQ ID NO:208); rice (*Oryza sativa*)_DGAT1 (gi57231736, SEQ ID NO:209); rice (*Oryza sativa*) DGAT1 (gi53791817, SEQ ID NO:210); rice (*Oryza sativa*) DGAT1 (gi51854436, SEQ ID NO:211); olive (*Olea europaea*)_DGAT1 (gi41387497, SEQ ID NO:212; *Medicago truncatula*_DGAT1 (gi124361135, SEQ ID NO:213); *Lotus japonica* DGAT1 (gi57545061, SEQ ID NO:214); *Jatropha curcas* DGAT1 (gi82582915, SEQ ID NO:215); burning bush *Euonymus alata* DGAT1 (gi118800682, SEQ ID NO:216); *Brassica napus* DGAT1 (gi7576941, SEQ ID NO:217); mustard *Brassica juncia* DGAT1 (gi63376226, SEQ ID NO:218); *Arabidopsis thaliana* DGAT1 (gi127266368, SEQ ID NO:219); maize (*Zea mays*) DGAT1 (gi187806720, SEQ ID NO:220); *Brassica napus* DGAT1 (gi91152589, SEQ ID NO:221); *Brassica napus* DGAT1 (gi91152588, SEQ ID NO:222).

Figure 6:
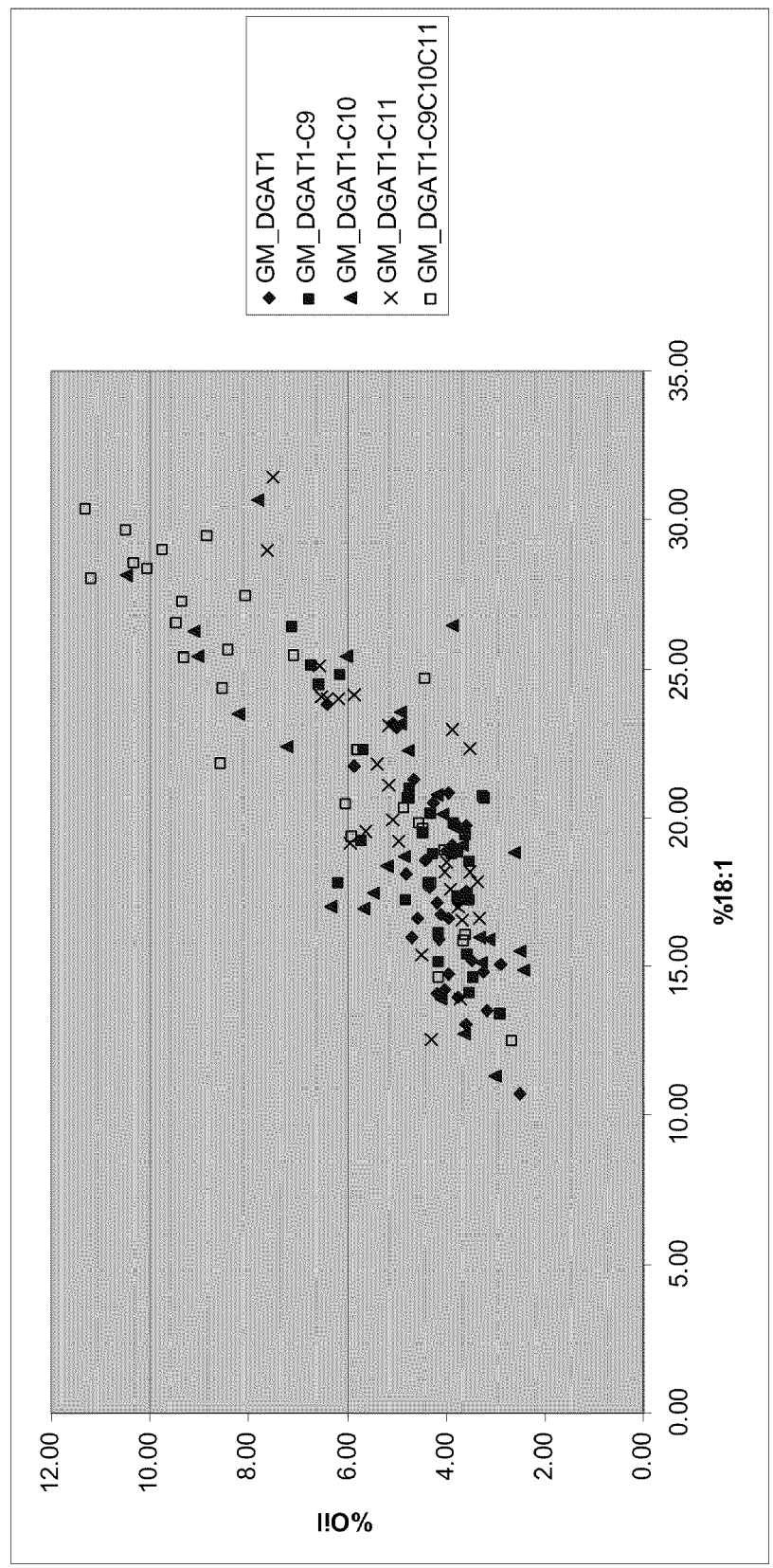

FIG. 6 provides oil concentration plotted versus oleic acid concentration for MSE2515, MSE 2516, MSE2517, MSE2518 and MSE2519 from Example 8.

The sequence descriptions summarize the Sequences Listing attached hereto. The Sequence Listing contains one letter codes for nucleotide sequence characters and the single and three letter codes for amino acids as defined in the IUPAC-IUB standards described in *Nucleic Acids Research* 13:3021-3030 (1985) and in the *Biochemical Journal* 219(2):345-373 (1984).

Summary of Nucleic Acid and Protein SEQ ID Numbers

| Description and Abbreviation | Nucleic acid SEQ ID NO. | Protein SEQ ID NO. |
|---|---|---|
| Hickory (*Carya ovata*) diacylglycerol acyltransferase 1a (CO-DGAT1a) | 7 (1617bp) | 8 (538aa) |
| Hickory (*Carya ovata*) diacylglycerol acyltransferase 1 a (CO-DGAT1b) | 9 (1617bp) | 10 (538aa) |
| Hazelnut (*Corylus americana*) diacylglycerol acyltransferase 1 (CA-DGAT1) | 11 (1620bp) | 12 (539aa) |
| Plasmid PHP32238 comprising the hickory DGAT1a (CO-DGAT1a) | 13 (9074bp) | |
| Plasmid PHP32396 comprising the hickory DGAT1b (CO-DGAT1b) | 14 (9074bp) | |
| Plasmid PHP32395 comprising the hazelnut DGAT1 (CA-DGAT1) | 15 (9077bp) | |
| Soybean (*Glycine max*) DGAT1 | | 16 (504aa) |
| *Arabidopsis thaliana* DGAT1 | | 17 (520aa) |
| Wheat (*Triticum aestivum*) DGAT1 | | 18 (508aa) |
| Maize (*Zea mays*) DGAT1 | | 19 (494aa) |
| Plasmid pKS394 | 20 (11696bp) | |
| Plasmid pKS352 | 21 (10866bp) | |
| Plasmid pSZ378 | 22 (7457bp) | |
| Hazelnut DGAT with internal BamHI and EcoRI sites removed (CA-DGAT1*) | 23 (1620bp) | |
| Plasmid pKR52 | 24 (9065bp) | |
| Hazelnut (*Corylus americana*) CA-DGAT1-A1 | 25 (1620bp) | 26 (539aa) |
| Hazelnut (*Corylus americana*) CA-DGAT1-A2 | 27 (1620bp) | 28 (539aa) |
| Hazelnut (*Corylus americana*) CA-DGAT1-A9 | 29 (1620bp) | 30 (539aa) |
| Hazelnut (*Corylus americana*) CA-DGAT1-A14 | 31 (1620bp) | 32 (539aa) |
| Hazelnut (*Corylus americana*) CA-DGAT1-A15 | 33 (1620bp) | 34 (539aa) |
| Hazelnut (*Corylus americana*) CA-DGAT1-A16 | 35 (1620bp) | 36 (539aa) |
| Hazelnut (*Corylus americana*) CA-DGAT1-A17 | 37 (1620bp) | 38 (539aa) |
| Hazelnut (*Corylus americana*) CA-DGAT1-B6 | 39 (1620bp) | 40 (539aa) |
| Hazelnut (*Corylus americana*) CA-DGAT1-C1 | 41 (1620bp) | 42 (539aa) |
| Hazelnut (*Corylus americana*) CA-DGAT1-C5 | 43 (1620bp) | 44 (539aa) |
| Hazelnut (*Corylus americana*) CA-DGAT1-C7 | 45 (1620bp) | 46 (539aa) |
| Hazelnut (*Corylus americana*) CA-DGAT1-C8 | 47 (1620bp) | 48 (539aa) |
| Hazelnut (*Corylus americana*) CA-DGAT1-C9 | 49 (1620bp) | 50 (539aa) |
| Hazelnut (*Corylus americana*) CA-DGAT1-C10 | 51 (1620bp) | 52 (539aa) |
| Hazelnut (*Corylus americana*) CA-DGAT1-C11 | 53 (1620bp) | 54 (539aa) |
| Hazelnut (*Corylus americana*) CA-DGAT1-C13 | 55 (1620bp) | 56 (539aa) |
| Hazelnut (*Corylus americana*) CA-DGAT1-C15 | 57 (1620bp) | 58 (539aa) |
| Hazelnut (*Corylus americana*) CA-DGAT1-D2 | 59 (1620bp) | 60 (539aa) |
| Hazelnut (*Corylus americana*) CA-DGAT1-D4 | 61 (1620bp) | 62 (539aa) |
| Hazelnut (*Corylus americana*) CA-DGAT1-D5 | 63 (1620bp) | 64 (539aa) |
| Hazelnut (*Corylus americana*) | 65 | 66 |
| CA-DGAT1-D6 Hazelnut (*Corylus americana*) | 67 (1620bp) | 68 (539aa) |
| CA-DGAT1-D7 Hazelnut (*Corylus americana*) | 69 (1620bp) | 70 (539aa) |
| CA-DGAT1-D8 Hazelnut (*Corylus americana*) | 71 (1620bp) | 72 (539aa) |
| CA-DGAT1-D9 Hazelnut (*Corylus americana*) | 73 (1620bp) | 74 (539aa) |
| CA-DGAT1-D10 Hazelnut (*Corylus americana*) | 75 (1620bp) | 76 (539aa) |
| CA-DGAT1-D12 Hazelnut (*Corylus americana*) | 77 (1620bp) | 78 (539aa) |
| CA-DGAT1-D14 Hazelnut (*Corylus americana*) | 79 (1620bp) | 80 (539aa) |
| CA-DGAT1-D15 Hazelnut (*Corylus americana*) | 81 (1620bp) | 82 (539aa) |
| CA-DGAT1-D16 Hazelnut (*Corylus americana*) | 83 (1620bp) | 84 (539aa) |
| CA-DGAT1-D17 Hazelnut (*Corylus americana*) | 85 (1620bp) | 86 (539aa) |
| CA-DGAT1-D18 Hazelnut (*Corylus americana*) | 87 (1620bp) | 88 (539aa) |
| CA-DGAT1-D19 Hazelnut (*Corylus americana*) | 89 (1620bp) | 90 (539aa) |
| CA-DGAT1-D20 Hazelnut (*Corylus americana*) | 91 (1620bp) | 92 (539aa) |
| CA-DGAT1-E1 Hazelnut (*Corylus americana*) | 93 (1620bp) | 94 (539aa) |
| CA-DGAT1-E2 Hazelnut (*Corylus americana*) | 95 (1620bp) | 96 (539aa) |
| CA-DGAT1-E3 Hazelnut (*Corylus americana*) | 97 (1620bp) | 98 (539aa) |
| CA-DGAT1-E4 Hazelnut (*Corylus americana*) | 99 (1620bp) | 100 (539aa) |
| CA-DGAT1-E5 Hazelnut (*Corylus americana*) | 101 (1620bp) | 102 (539aa) |
| CA-DGAT1-E6 Hazelnut (*Corylus americana*) | 103 (1620bp) | 104 (539aa) |
| CA-DGAT1-E7 Hazelnut (*Corylus americana*) | 105 (1620bp) | 106 (539aa) |
| CA-DGAT1-E8 Hazelnut (*Corylus americana*) | 107 (1620bp) | 108 (539aa) |
| CA-DGAT1-E9 Hazelnut (*Corylus americana*) | 109 (1620bp) | 110 (539aa) |
| CA-DGAT1-E10 Hazelnut (*Corylus americana*) | 111 (1620bp) | 112 (539aa) |
| CA-DGAT1-E11 Hazelnut (*Corylus americana*) | 113 (1620bp) | 114 (539aa) |
| CA-DGAT1-E13 Hazelnut (*Corylus americana*) | 115 (1620bp) | 116 (539aa) |
| CA-DGAT1-E15 Hazelnut (*Corylus americana*) | 117 (1620bp) | 118 (539aa) |
| CA-DGAT1-E16 Hazelnut (*Corylus americana*) | 119 (1620bp) | 120 (539aa) |
| CA-DGAT1-E19 Hazelnut (*Corylus americana*) | 121 (1620bp) | 122 (539aa) |
| CA-DGAT1-F4 Hazelnut (*Corylus americana*) | 123 (1620bp) | 124 (539aa) |
| CA-DGAT1-F8 Hazelnut (*Corylus americana*) | 125 (1620bp) | 126 (539aa) |
| CA-DGAT1-F17 Hazelnut (*Corylus americana*) | 127 (1620bp) | 128 (539aa) |
| CA-DGAT1-F18 Hazelnut (*Corylus americana*) | 129 (1620bp) | 130 (539aa) |
| CA-DGAT1-F19 Hazelnut (*Corylus americana*) | 131 (1620bp) | 132 (539aa) |
| CA-DGAT1-J1 Hazelnut (*Corylus americana*) | 133 (1620bp) | 134 (539aa) |
| CA-DGAT1-J12 Hazelnut (*Corylus americana*) | 135 (1620bp) | 136 (539aa) |
| CA-DGAT1-J13 Hazelnut (*Corylus americana*) | 137 (1620bp) | 138 (539aa) |
| CA-DGAT1-J16 Hazelnut (*Corylus americana*) | 139 (1620bp) | 140 (539aa) |
| CA-DGAT1-J21 Hazelnut (*Corylus americana*) | 141 (1620bp) | 142 (539aa) |
| CA-DGAT1-J24 | (1620bp) | (539aa) |

| Description and Abbreviation | Nucleic acid SEQ ID NO. | Protein SEQ ID NO. |
|---|---|---|
| Hazelnut (*Corylus americana*) CA-DGAT1-J32 | 143 (1620bp) | 144 (539aa) |
| Hazelnut (*Corylus americana*) CA-DGAT1-J34 | 145 (1620bp) | 146 (539aa) |
| Hazelnut (*Corylus americana*) CA-DGAT1-J37 | 147 (1620bp) | 148 (539aa) |
| Hazelnut (*Corylus americana*) CA-DGAT1-J38 | 149 (1620bp) | 150 (539aa) |
| Plasmid PHP35885 | 151 (9065bp) | |
| Soybean (*Glycine max*) GM-DGAT1 | 152 (1515bp) | 153 (504aa) |
| Soybean (*Glycine max*) GM-DGAT1-C9 | 154 (1515bp) | 155 (504aa) |
| Soybean (*Glycine max*) GM-DGAT1-C10 | 156 (1515bp) | 157 (504aa) |
| Soybean (*Glycine max*) GM-DGAT1-C11 | 158 (1515bp) | 159 (504aa) |
| Soybean (*Glycine max*) GM-DGAT1-C9C10C11 | 160 (1515bp) | 161 (504aa) |
| Maize (*Zea mays*) ZM-DGAT1(MOD1) | 162 (1485bp) | |
| Maize (*Zea mays*) ZM-DGAT1(MOD2) | 163 (1485bp) | 164 (494aa) |
| Maize (*Zea mays*) ZM-DGAT1(MOD3) | 165 (1485bp) | 166 (494aa) |
| Maize (*Zea mays*) ZM-DGAT1(MOD4) | 167 (1485bp) | 168 (494aa) |
| Maize (*Zea mays*) ZM-DGAT1(MOD5) | 169 (1485bp) | 170 (494aa) |
| Plasmid PHP40102 | 171 (8948bp) | |
| Maize-Hazelnut DGAT1 chimera | 172 (1482bp) | 173 (493aa) |
| Maize-Hazelnut DGAT1-C11 chimera | 174 (1482bp) | 175 (493aa) |
| Peptide 1 from hazelnut DGAT | | 176 (15aa) |
| Peptide 2 from maize DGAT | | 177 (16aa) |
| Plasmid pKR72 | 178 (7085bp) | |
| Plasmid pKR1466 | 179 (8611bp) | |
| Plasmid pKR1515 | 180 (8611bp) | |
| Plasmid pKR1516 | 181 (8611bp) | |
| Plasmid pKR1517 | 182 (8611bp) | |
| Plasmid pKR1520 | 183 (8611bp) | |
| Soybean (*Glycine max*) GM-DGAT1-J16 | 184 (1515bp) | 185 (504aa) |
| Soybean (*Glycine max*) GM-DGAT1-J24 | 186 (1515bp) | 187 (504aa) |
| Soybean (*Glycine max*) GM-DGAT1-J32 | 188 (1515bp) | 189 (504aa) |
| Soybean (*Glycine max*) GM-DGAT1-J37 | 190 (1515bp) | 191 (504aa) |
| Soybean (*Glycine max*) GM-DGAT1-J16J24J32J37 | 192 (1515bp) | 193 (504aa) |
| Soybean (*Glycine max*) GM-DGAT1-Jall Call | 194 (1515bp) | 195 (504aa) |
| Soybean (*Glycine max*) GmDGAT1_gi56199782 | | 196 (498aa) |
| Soybean (*Glycine max*) GmDGAT1a gi93204650 | | 197 (498aa) |
| Soybean (*Glycine max*) GmDGAT1b_gi93204652 | | 198 (504aa) |
| Maize (*Zea mays*) ZM-DGAT1 gi187806722 | | 199 (494aa) |
| *Arabidopsis thaliana* DGAT1_gi91152592 | | 200 (547aa) |
| Grape (*Vitis vinifora*)_ DGAT1_gi225444869 | | 201 (518aa) |
| Grape | | 202 |
| (*Vitis vinifora*)_ DGAT1_gi147859067 | | (502aa) |
| *Vernonia galamensis*_ DGAT1_gi157092192 | | 203 (517aa) |
| *Vernonia galamensis* _ DGAT1_gi157092190 | | 204 (523aa) |
| Tung oil tree (*Vernicia fordii*)_DGAT1 gi86279632 | | 205 (526aa) |
| *Tropaeolum majus* DGAT1 gi67043496 | | 206 (518aa) |
| *Populus trichocarpa*_ DGAT1_gi224087975 | | 207 (446aa) |
| Beefsteak (*Perilla frutescens*) DGAT1 gi10803053 | | 208 (534aa) |
| Rice (*Oryza sativa*)_ DGAT1_gi57231736 | | 209 (538aa) |
| Rice (*Oryza sativa*) DGAT1___gi53791817 | | 210 (477aa) |
| Rice (*Oryza sativa*)_ DGAT1_gi51854436 | | 211 (504aa) |
| Olive (*Olea europaea*)_ DGAT1_gi41387497 | | 212 (532aa) |
| *Medicago truncatula*_ DGAT1_gi124361135 | | 213 (539aa) |
| *Lotus japonica* DGAT1___gi57545061 | | 214 (511aa) |
| *Jatropha curcas*_ DGAT1_gi82582915 | | 215 (521aa) |
| *Euonymus alata*_ DGAT1_gi118800682 | | 216 (507aa) |
| *Brassica napus*_ DGAT1_gi7576941 | | 217 (501aa) |
| *Brassica juncia*_ DGAT1_gi63376226 | | 218 (503aa) |
| *Arabidopsis thaliana*_ DGAT1 gi127266368 | | 219 (520aa) |
| Maize (*Zea mays*) DGAT1_gi187806720 | | 220 (494aa) |
| *Brassica napus*_ DGAT1_gi91152589 | | 221 (503aa) |
| *Brassica napus*_ DGAT1_gi91152588 | | 222 (341aa) |

SEQ ID NOs:1-6 correspond to primers (p21, p18, p33, p34, p37b, and p38, respectively) used to PCR amplify the two hickory (*Carya ovata*) and one hazelnut (*Corylus americana*) DGAT1 genes.

DETAILED DESCRIPTION OF THE INVENTION

The disclosure of each reference set forth herein is hereby incorporated by reference in its entirety.

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

In the context of this disclosure, a number of terms and abbreviations are used. The following definitions are provided.

"Open reading frame" is abbreviated ORF.

"Polymerase chain reaction" is abbreviated PCR.

"American Type Culture Collection" is abbreviated ATCC.

Acyl-CoA:sterol-acyltransferase" is abbreviated ARE2.

"Phospholipid:diacylglycerol acyltransferase" is abbreviated PDAT.

"Diacylglycerol acyltransferase" is abbreviated DAG AT or DGAT.

"Diacylglycerol" is abbreviated DAG.

"Triacylglycerols" are abbreviated TAGs.

"Co-enzyme A" is abbreviated CoA.

The term "fatty acids" refers to long chain aliphatic acids (alkanoic acids) of varying chain length, from about $C_{12}$ to $C_{22}$ (although both longer and shorter chain-length acids are known). The predominant chain lengths are between $C_{16}$ and $C_{22}$. The structure of a fatty acid is represented by a simple notation system of "X:Y", where X is the total number of carbon (C) atoms in the particular fatty acid and Y is the number of double bonds.

Generally, fatty acids are classified as saturated or unsaturated. The term "saturated fatty acids" refers to those fatty acids that have no "double bonds" between their carbon backbone. In contrast, "unsaturated fatty acids" have "double bonds" along their carbon backbones (which are most commonly in the cis-configuration). "Monounsaturated fatty acids" have only one "double bond" along the carbon backbone (e.g., usually between the $9^{th}$ and $10^{th}$ carbon atom as for palmitoleic acid (16:1) and oleic acid (18:1)), while "polyunsaturated fatty acids" (or "PUFAs") have at least two double bonds along the carbon backbone (e.g., between the $9^{th}$ and $10^{th}$, and $12^{th}$ and $13^{th}$ carbon atoms for linoleic acid (18:2); and between the $9^{th}$ and $10^{th}$, $12^{th}$ and $13^{th}$, and $15^{th}$ and $16^{th}$ for α-linolenic acid (18:3)).

"Microbial oils" or "single cell oils" are those oils naturally produced by microorganisms (e.g., algae, oleaginous yeasts and filamentous fungi) during their lifespan. The term "oil" refers to a lipid substance that is liquid at 25° C. and usually polyunsaturated. In contrast, the term "fat" refers to a lipid substance that is solid at 25° C. and usually saturated.

"Lipid bodies" refer to lipid droplets that usually are bounded by specific proteins and a monolayer of phospholipid. These organelles are sites where most organisms transport/store neutral lipids. Lipid bodies are thought to arise from microdomains of the endoplasmic reticulum that contain TAG-biosynthesis enzymes; and, their synthesis and size appear to be controlled by specific protein components.

"Neutral lipids" refer to those lipids commonly found in cells in lipid bodies as storage fats and oils and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or TAG, respectively (or collectively, acylglycerols). A hydrolysis reaction must occur to release free fatty acids from acylglycerols.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long chain PUFAs, as well as shorter saturated and unsaturated fatty acids and longer chain saturated fatty acids. Thus, "oil biosynthesis" generically refers to the synthesis of TAGs in the cell.

The term "DAG AT" or "DGAT" refers to a diacylglycerol acyltransferase (also known as an acyl-CoA-diacylglycerol acyltransferase or a diacylglycerol O-acyltransferase) (EC 2.3.1.20). This enzyme is responsible for the conversion of acyl-CoA and 1,2-diacylglycerol to TAG and CoA (thereby involved in the terminal step of TAG biosynthesis). Two families of DAG AT enzymes exist: DGAT1 and DGAT2. The former family shares homology with the acyl-CoA:cholesterol acyltransferase (ACAT) gene family, while the latter family is unrelated (Lardizabal et al., *J. Biol. Chem.* 276(42): 38862-28869 (2001)).

The term "PDAT" refers to a phospholipid:diacylglycerol acyltransferase enzyme (EC 2.3.1.158). This enzyme is responsible for the transfer of an acyl group from the sn-2 position of a phospholipid to the sn-3 position of 1,2-diacylglycerol, thus resulting in lysophospholipid and TAG (thereby involved in the terminal step of TAG biosynthesis). This enzyme differs from DGAT (EC 2.3.1.20) by synthesizing TAG via an acyl-CoA-independent mechanism.

The term "ARE2" refers to an acyl-CoA:sterol-acyltransferase enzyme (EC 2.3.1.26; also known as a sterol-ester synthase 2 enzyme), catalyzing the following reaction: acyl-CoA+cholesterol=CoA+cholesterol ester.

As used herein, "nucleic acid" means a polynucleotide and includes single or double-stranded polymer of deoxyribonucleotide or ribonucleotide bases. Nucleic acids may also include fragments and modified nucleotides. Thus, the terms "polynucleotide", "nucleic acid sequence", "nucleotide sequence" or "nucleic acid fragment" are used interchangeably and is a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deosycytidylate, "G" for guanylate or deoxyguanylate, "U" for uridlate, "T" for deosythymidylate, "R" for purines (A or G), "Y" for pyrimidiens (C or T), "K" for G or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The terms "homology", "homologous", "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth et al., Anal. Biochem. 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel et al., Eds., Greene Publishing and Wiley-Interscience, New York (1995). Hybridization and/or wash conditions can be applied for at least 10, 30, 60, 90, 120, or 240 minutes.

"Sequence identity" or "identity" in the context of nucleic acid or polypeptide sequences refers to the nucleic acid bases or amino acid residues in two sequences that are the same when aligned for maximum correspondence over a specified comparison window.

Thus, "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, *CABIOS.* 5:151-153 (1989); Higgins, D. G. et al. (1992) *Comput. Appl. Biosci.* 8:189-191) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

"BLASTN method of alignment" is an algorithm provided by the National Center for Biotechnology Information (NCBI) to compare nucleotide sequences using default parameters.

It is well understood by one skilled in the art that many levels of sequence identity are useful in identifying polypeptides, from other species, wherein such polypeptides have the same or similar function or activity. Useful examples of percent identities include, but are not limited to, 50%, 55%, 60%, 65%, 70%, 75%, 80%, 85%, 90%, or 95%, or any integer percentage from 50% to 100%. Indeed, any integer amino acid identity from 50% to 100% may be useful in describing the present invention, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

The term "genome" as it applies to a plant cells encompasses not only chromosomal DNA found within the nucleus, but organelle DNA found within subcellular components (e.g., mitochondrial, plastid) of the cell.

A "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same that plant is homozygous at that locus. If the alleles present at a given locus on a chromosome differ that plant is heterozygous at that locus.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters". New promoters of various types useful in plant cells are constantly being discovered; numerous examples may be found in the compilation by Okamuro, J. K., and Goldberg, R. B. *Biochemistry of Plants* 15:1-82 (1989).

"Translation leader sequence" refers to a polynucleotide sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D., *Mol. Biotechnol.* 3:225-236 (1995)).

"3'non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht, I. L., et al. *Plant Cell* 1:671-680 (1989).

"RNA transcript" refers to the product resulting from RNA polymerase-catalyzed transcription of a DNA sequence. When the RNA transcript is a perfect complementary copy of the DNA sequence, it is referred to as the primary transcript. A RNA transcript is referred to as the mature RNA when it is a RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, a mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory: Cold Spring Harbor, N.Y. (1989). Transformation methods are well known to those skilled in the art and are described infra.

"PCR" or "polymerase chain reaction" is a technique for the synthesis of large quantities of specific DNA segments and consists of a series of repetitive cycles (Perkin Elmer Cetus Instruments, Norwalk, Conn.). Typically, the double-stranded DNA is heat denatured, the two primers complementary to the 3' boundaries of the target segment are annealed at low temperature and then extended at an intermediate temperature. One set of these three consecutive steps is referred to as a "cycle".

The term "recombinant" refers to an artificial combination of two otherwise separated segments of sequence, e.g., by chemical synthesis or by the manipulation of isolated segments of nucleic acids by genetic engineering techniques.

The terms "plasmid", "vector" and "cassette" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host (i.e., to a discrete nucleic acid fragment into which a nucleic acid sequence or fragment can be moved.)

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The term "expression", as used herein, refers to the production of a functional end-product (e.g., a mRNA or a protein [either precursor or mature]).

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms.

As used herein, "transgenic" refers to a plant or a cell which comprises within its genome a heterologous polynucleotide. Preferably, the heterologous polynucleotide is stably integrated within the genome such that the polynucleotide is passed on to successive generations. The heterologous polynucleotide may be integrated into the genome alone or as part of an expression construct. Transgenic is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

"Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020). Co-suppression constructs in plants previously have been designed by focusing on overexpression of a nucleic acid sequence having homology to an endogenous mRNA, in the sense orientation, which results in the reduction of all RNA having homology to the overexpressed sequence (Vaucheret et al., *Plant J.* 16:651-659 (1998); Gura, *Nature* 404:804-808 (2000)). The overall efficiency of this phenomenon is low, and the extent of the RNA reduction is widely variable. More recent work has described the use of "hairpin" structures that incorporate all, or part, of an mRNA encoding sequence in a complementary orientation that results in a potential "stem-loop" structure for the expressed RNA (PCT Publication No. WO 99/53050, published Oct. 21, 1999; PCT Publication No. WO 02/00904, published Jan. 3, 2002). This increases the frequency of co-suppression in the recovered transgenic plants. Another variation describes the use of plant viral sequences to direct the suppression, or "silencing", of proximal mRNA encoding sequences (PCT Publication No. WO 98/36083, published Aug. 20, 1998). Both of these co-suppressing phenomena have not been elucidated mechanistically, although genetic evidence has begun to unravel this complex situation (El-mayan et al., *Plant Cell* 10:1747-1757 (1998)).

The term "oleaginous" refers to those organisms that tend to store their energy source in the form of lipid (Weete, In: Fungal Lipid Biochemistry, 2$^{nd}$ Ed., Plenum, 1980). A class of plants identified as oleaginous are commonly referred to as "oilseed" plants. Examples of oilseed plants include, but are not limited to: soybean (*Glycine* and *Soja* sp.), flax (*Linum* sp.), rapeseed (*Brassica* sp.), maize, cotton, safflower (*Carthamus* sp.) and sunflower (*Helianthus* sp.).

Within oleaginous microorganisms the cellular oil or TAG content generally follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.* 57:419-25 (1991)).

Also described herein are oleaginous microbial organisms produced by the methods described herein. This therefore includes oleaginous bacteria, algae, moss, euglenoids, stramenopiles fungi and yeast, comprising in their genome a recombinant construct incorporating an isolated nucleic acid of the present invention. Additionally, lipids and oils obtained from these oleaginous organisms, products obtained from the processing of the lipids and oil, use of these lipids and oil in foods, animal feeds or industrial applications and/or use of the by-products in foods or animal feeds are also described. Examples of microalgae include, but are not limited to *Rhodomonas salina, Crypthecodinium cohnii, Chaetoceros lauderi, Pavlova pinguis*, and *Emiliania huxleyi*. There is currently great interest in using oleaginous microalgae to produce oil for biofuels, or for use as nutraceuticals or cosmetics (Hu et al, 2008, *Plant J* 54:621-639; Waltz, 2009, *Nature Biotechnology* 27: 15-18.) The approach of overexpressing genes in microalgae to improve oil production for biofuels applications is being explored (Waltz, 2009, *Nature Biotchnology* 27:15-18.)

The term "oleaginous yeast" refers to those microorganisms classified as yeasts that make oil. It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

"Progeny" comprises any subsequent generation of a plant.

"Non-transgenic, null segregant soybean seed" refers to a near isogenic plant or seed that lacks the transgene, and/or a parental plant used in the transformation process to obtain the transgenic event. Null segregants can be plants or seed that do not contain the transgenic trait due to normal genetic segregation during propagation of the heterozygous transgenic plants.

A "kernel" is the corn caryopsis, consisting of a mature embryo and endosperm which are products of double fertilization. The term "corn" or "maize" represents any variety, cultivar, or population of *Zea mays* L.

"Grain" comprises mature corn kernels produced by commercial growers for on farm use or for sale to customers in both cases for purposes other than growing or reproducing the species. The "seed" is the mature corn kernel produced for the purpose of propagating the species and for sale to commercial growers. As used herein the terms seeds, kernels, and grains can be used interchangeably. The "embryo" or also termed "germ" is a young sporophytic plant, before the start of a period of rapid growth (seed germination). The embryo (germ) of corn contains the vast majority of the oil found in the kernel. The structure of embryo in cereal grain includes the embryonic axis and the scutellum. The "scutellum" is the single cotyledon of a cereal grain embryo, specialized for absorption of the endosperm. The "aleurone" is a proteinaceous material, usually in the form of small granules, occurring in the outermost cell layer of the endosperm of corn and other grains.

Plant oil is a valuable renewable resource, with annual world production of 145 million metric tons valued at over 80 billion U.S. dollars (Rupilius and Ahmad, 2007, *Eur J Lipid Sci Technol* 109:433-439). Discovering ways to increase the oil content of plants is therefore desired. Previous transgenic studies showed that diacylglycerol acyltransferase (DGAT) has a role in controlling oil production in plants.

Ectopic expression of an *Arabidopsis* type I DGAT gene in *Arabidopsis* increased seed oil content (Jako et al., 2001, *Plant Physiology* 126: 861-874). Likewise, ectopic expression of maize type I DGAT alleles in maize increased kernel and embryo oil content (Zheng et al., 2008, *Nature Genetics* 40:367-372). Increased oil in *Brassica napus* was observed as a result of ectopic expression of *Arabidopisis* and *Brassica napus* type I DGAT genes (Weselake et al., 2008, *J Exper Bot* 59: 3543-3549), or a nasturtium type I DGAT gene (Xu et al, 2008, *Plant Biotechnology J* 6:799-818). Non-higher plant DGATs have also been used, the type 2 DGAT from the fungus Umbelopsis ramanniana increased oil content when expressed in soybean (Lardizabal et al., 2008, Plant Physiol 148: 89-96).

Discovery of DGAT enzymes with higher activity or with better kinetic or regulatory properties may lead to still greater increases in plant oil content than achieved previously. Extremely high oil plant tissues may be good sources of DGAT genes that encode enzymes with favorable properties.

"Tree nuts" and edible nuts from some trees and shrubs have very high oil contents in comparison with important oil crops of the world (Gunstone et al., 1994, *The Lipid Handbook*, 2$^{nd}$ Edition, Chapman and Hall, 2-6 Boundary Row, London SE1 8HN, UK, page 112). For example, the nuts of hazelnut and hickory have 62% and 70% oil, respectively. In addition to high oil contents, some of the edible nuts also have oil with a high proportion of oleic acid. For example, the oil of hazelnut and hickory contains 76% and 52% oleic acid, respectively (Gunstone et al., 1994, *The Lipid Handbook*, 2$^{nd}$ Edition, Chapman and Hall, 2-6 Boundary Row, London SE1 8HN, UK, page 112).

The DGAT genes from these species may therefore be especially effective in high oleic crops that contain a high proportion of oleoyl-CoA and di-oleoyl diacylglycerol as substrates during the oil formation period of development. It is therefore of interest to express the DGAT genes obtained from high oil and high oleic tissues in high oleic crops containing reduced FAD2 (delta-12 fatty acid desaturase) activity, achieved either through plant breeding or transgenically.

As is discussed in the Examples below a representative of the hazelnut genus *Corylus*, a DGAT cDNA from American hazelnut (*Corylus americana*) was isolated. The hazelnut genus *Corylus* also includes many other closely related species that would be expected to have DGATs with similar properties and high sequence identity, including the species for common hazelnut (*avellana*), beaked hazelnut (*cornuta*), Filbert (*maxima*), and Turkish hazelnut (*colurna*), among numerous others.

As is discussed in the Examples below a representative of the hickory/pecan genus *Carya*, a DGAT cDNAs from shagbark hickory (*Carya ovata*) was isolated. The hickory/pecan genus *Carya* also includes many other closely related species that would be expected to have DGATs with similar properties and high sequence identity, including the species for pecan (*illinoinensis*), shellbark hickory (*laciniosa*), mockernut hickory (*tomentosa*), pignut hickory (*glabra*), bitternut hickory (*cordiformis*), Chinese hickory (*cathayensis*), and Vietnamese hickory (*tonkinensis*), among numerous others.

The method disclosed here to obtain and test DGAT cDNAs from American hazelnut and shagbark hickory could also be used to obtain and test DGAT cDNAs from these other species of the *Corylus* or *Carya* genera, or from other edible nuts described in (Gunstone et al., 1994, The Lipid Handbook, 2$^{nd}$ Edition, Chapman and Hall, 2-6 Boundary Row, London SE1 8HN, UK, page 112), such as pistachio (57% oil, 69% oleic) for example.

In addition to obtaining DGAT genes with desirable properties from novel sources like tree nuts, protein engineering approaches could also be taken to improve kinetic, regulatory, or other properties of DGAT. This DGAT engineering approach has not been thoroughly explored to date. Several amino acid substitutions were made in the nasturtium DGAT, but only one of these substitutions, a serine to alanine change at position 197, resulted in increased specific activity (Xu et al, 2008, *Plant Biotechnology J* 6:799-818). This position corresponds to serine 216 in the hazelnut DGAT sequence of the present invention. In another study, multiple random mutations were made in *Brassica napus* DGAT, and some mutated enzymes increased oil content in yeast (Siloto et al., 2009, Plant Physiol Biochem 47:456-461). However, the identity of the mutations was not reported, and no demonstrations of increased oil in a plant tissue as a result of multiple simultaneous amino acid substitutions in DGAT have been reported prior to the present study described in the Examples section.

The present invention concerns a transgenic soybean seed having increased total fatty acid content of at least 10% when compared to the total fatty acid content of a null segregant soybean seed. It is understood that any measurable increase in the total fatty acid content of a transgenic versus a null segregant would be useful. Such increases in the total fatty acid content would include, but are not limited to, at least 1%, 2%, 3%, 4%, 5%, 6%, 7%, 8%, 9%, 11%, 12%, 13%, 14%, 15%, 16%, 17%, 18%, 19%, or 20%.

A transgenic oilseed of the invention can comprise a recombinant construct having at least one DGAT sequence. This DGAT sequence can be selected from the group consisting of DGAT1, DGAT2 and DGAT1 in combination with DGAT2. Furthermore, at least one DGAT sequence can be from a tree nut or a shuffled DGAT. Examples of suitable DGAT sequences that can be used to practice the invention are discussed in the Examples below. There can be mentioned SEQ ID NOs: 7, 9, 11, 51, 53, 137, 141, 143, 147, 156, 160, 163, 165, 167, 169, 184, 186, 188, 190, 192, and 194, in the present invention. Those skilled in the art will appreciate that the instant invention includes, but is not limited to, the DGAT sequences disclosed herein.

Such a recombinant construct promoter would comprise different components such as a promoter which is a DNA sequence that directs cellular machinery of a plant to produce RNA from the contiguous coding sequence downstream (3') of the promoter. The promoter region influences the rate, developmental stage, and cell type in which the RNA transcript of the gene is made. The RNA transcript is processed to produce mRNA which serves as a template for translation of the RNA sequence into the amino acid sequence of the encoded polypeptide. The 5' non-translated leader sequence is a region of the mRNA upstream of the protein coding region that may play a role in initiation and translation of the mRNA. The 3' transcription termination/polyadenylation signal is a non-translated region downstream of the protein coding region that functions in the plant cell to cause termination of the RNA transcript and the addition of polyadenylate nucleotides to the 3' end of the RNA.

The origin of the promoter chosen to drive expression of the DGAT coding sequence is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha prime subunit of beta conglycinin promoter, the Kunitz trypsin inhibitor 3 promoter, the annexin promoter, the glycinin Gy1 promoter, the beta subunit of beta conglycinin promoter, the P34/Gly Bd m 30K promoter, the albumin promoter, the Leg A1 promoter and the Leg A2 promoter.

The annexin, or P34, promoter is described in PCT Publication No. WO 2004/071178 (published Aug. 26, 2004). The level of activity of the annexin promoter is comparable to that of many known strong promoters, such as: (1) the CaMV 35S promoter (Atanassova et al., *Plant Mol. Biol.* 37:275-285 (1998); Battraw and Hall, *Plant Mol. Biol.* 15:527-538 (1990); Holtorf et al., *Plant Mol. Biol.* 29:637-646 (1995);

Jefferson et al., *EMBO J.* 6:3901-3907 (1987); Wilmink et al., *Plant Mol. Biol.* 28:949-955 (1995)); (2) the *Arabidopsis* oleosin promoters (Plant et al., *Plant Mol. Biol.* 25:193-205 (1994); Li, Texas A&M University Ph.D. dissertation, pp. 107-128 (1997)); (3) the *Arabidopsis* ubiquitin extension protein promoters (Callis et al., *J. Biol. Chem.* 265(21):12486-93 (1990)); (4) a tomato ubiquitin gene promoter (Rollfinke et al., *Gene.* 211(2):267-76 (1998)); (5) a soybean heat shock protein promoter (Schoffl et al., *Mol Gen Genet.* 217(2-3): 246-53 (1989)); and, (6) a maize H3 histone gene promoter (Atanassova et al., *Plant Mol. Biol.* 37(2):275-85 (1989)).

Another useful feature of the annexin promoter is its expression profile in developing seeds. The annexin promoter is most active in developing seeds at early stages (before 10 days after pollination) and is largely quiescent in later stages. The expression profile of the annexin promoter is different from that of many seed-specific promoters, e.g., seed storage protein promoters, which often provide highest activity in later stages of development (Chen et al., *Dev. Genet.* 10:112-122 (1989); Ellerstrom et al., *Plant Mol. Biol.* 32:1019-1027 (1996); Keddie et al., *Plant Mol. Biol.* 24:327-340 (1994); *Plant* et al., (supra); Li, (supra)). The annexin promoter has a more conventional expression profile but remains distinct from other known seed specific promoters. Thus, the annexin promoter will be a very attractive candidate when overexpression, or suppression, of a gene in embryos is desired at an early developing stage. For example, it may be desirable to overexpress a gene regulating early embryo development or a gene involved in the metabolism prior to seed maturation.

Following identification of an appropriate promoter suitable for expression of a specific DGAT-coding sequence, the promoter is then operably linked in a sense orientation using conventional means well known to those skilled in the art.

Standard recombinant DNA and molecular cloning techniques used herein are well known in the art and are described more fully in Sambrook, J. et al., In *Molecular Cloning: A Laboratory Manual;* 2$^{nd}$ ed.; Cold Spring Harbor Laboratory Press: Cold Spring Harbor, N.Y., 1989 (hereinafter "Sambrook et al., 1989") or Ausubel, F. M., Brent, R., Kingston, R. E., Moore, D. D., Seidman, J. G., Smith, J. A. and Struhl, K., Eds.; In *Current Protocols in Molecular Biology*; John Wiley and Sons: New York, 1990 (hereinafter "Ausubel et al., 1990").

In another aspect, this invention concerns a method for increasing the total fatty acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% when compared to the total fatty acid content of a null segregant soybean seed.

Once the recombinant construct has been made, it may then be introduced into a plant cell of choice by methods well known to those of ordinary skill in the art (e.g., transfection, transformation and electroporation). Oilseed plant cells are the preferred plant cells. The transformed plant cell is then cultured and regenerated under suitable conditions permitting selection of those transformed soybean cell(s) having an increased total fatty acid content of at least 10% when compared to the total fatty acid content of a null segregant soybean seed.

Such recombinant constructs may be introduced into one plant cell; or, alternatively, each construct may be introduced into separate plant cells.

Expression in a plant cell may be accomplished in a transient or stable fashion as is described above.

Also within the scope of this invention are seeds or plant parts obtained from such transformed plants.

Plant parts include differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or a group of tissues that constitute a morphologically and functionally distinct part of a plant. The term "genome" refers to the following: (1) the entire complement of genetic material (genes and non-coding sequences) that is present in each cell of an organism, or virus or organelle; and/or (2) a complete set of chromosomes inherited as a (haploid) unit from one parent.

Methods for transforming dicots (primarily by use of *Agrobacterium tumefaciens*) and obtaining transgenic plants have been published, among others, for: cotton (U.S. Pat. Nos. 5,004,863; 5,159,135); soybean (U.S. Pat. Nos. 5,569,834; 5,416,011); *Brassica* (U.S. Pat. No. 5,463,174); peanut (Cheng et al. *Plant Cell Rep.* 15:653-657 (1996); McKently et al. *Plant Cell Rep.* 14:699-703 (1995)); papaya (Ling, K. et al. *Bio/technology* 9:752-758 (1991)); and pea (Grant et al. *Plant Cell Rep.* 15:254-258 (1995)). For a review of other commonly used methods of plant transformation see Newell, C. A. (*Mol. Biotechnol.* 16:53-65 (2000)). One of these methods of transformation uses *Agrobacterium rhizogenes* (Tepfler, M. and Casse-Delbart, F. *Microbiol. Sci.* 4:24-28 (1987)). Transformation of soybeans using direct delivery of DNA has been published using PEG fusion (PCT Publication No. WO 92/17598), electroporation (Chowrira, G. M. et al., *Mol. Biotechnol.* 3:17-23 (1995); Christou, P. et al., *Proc. Natl. Acad. Sci. U.S.A.* 84:3962-3966 (1987)), microinjection and particle bombardement (McCabe, D. E. et. al., *Bio/Technology* 6:923 (1988); Christou et al., *Plant Physiol.* 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for: the construction, manipulation and isolation of macromolecules (e.g., DNA molecules, plasmids, etc.); the generation of recombinant DNA fragments and recombinant expression constructs; and, the screening and isolating of clones. See, for example: Sambrook et al., Molecular Cloning: A Laboratory Manual, Cold Spring Harbor: NY (1989); Maliga et al., Methods in Plant Molecular Biology, Cold Spring Harbor: NY (1995); Birren et al., Genome Analysis: Detecting Genes, Vol. 1, Cold Spring Harbor: NY (1998); Birren et al., Genome Analysis: Analyzing DNA, Vol. 2, Cold Spring Harbor: NY (1998); Plant Molecular Biology: A Laboratory Manual, eds. Clark, Springer: NY (1997).

Examples of oilseed plants include, but are not limited to: soybean, *Brassica* species, sunflower, maize, cotton, flax and safflower.

In another aspect, this invention concerns a transgenic corn kernel having increased total fatty acid content of at least 10% when compared to the total fatty acid content of a null segregant corn kernel. Such a transgenic corn kernel can comprise a recombinant construct having at least one DGAT sequence. This DGAT sequence can be selected from the group consisting of DGAT1, DGAT2, or DGAT1 in combination with DGAT2.

In still another aspect, the present invention concerns a method for increasing the total fatty acid content of a corn kernel comprising:
(a) transforming at least one corn kernel with a recombinant construct having at least one DGAT sequence;
(b) selecting the transformed corn kernel(s) of step (a) having an increased total fatty acid content of at least 10% when compared to the total fatty acid content of a null segregant corn kernel.

The present invention also concerns a transgenic soybean seed having increased total fatty acid content of at least 10% and an increased oleic acid content of at least 25% when compared to the total fatty acid content and oleic acid content of a null segregant soybean seed. And the present invention further concerns a transgenic soybean having increased total fatty acid content of at least 10% and at least any one of i) an increased oleic acid content of at least 25%; ii) a decreased linolenic acid content of at least 25%; iii) a decreased linoleic acid content of at least 4%; iv) a decreased palmitic acid content of at least 8%; and v) an increased stearic acid content of at lease 14% when compared to the total fatty acid content and oleic, linolenic acid, linoleic acid, palmitic acid or stearic acid, respectively, content of a null segregant soybean seed.

In still a further aspect, the present invention also concerns a method for increasing the total fatty acid content and oleic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and an increased oleic acid content of at least 25% when compared to the total fatty acid content and oleic acid content of a null segregant soybean seed.

In still yet a further aspect, the present invention concerns a method for increasing the total fatty acid content and decreasing linolenic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased linolenic acid content of at least 25% when compared to the total fatty acid content and oleic acid content of a null segregant soybean seed.

Yet again in a further aspect, the present invention concerns a method for increasing the total fatty acid content and decreasing linoleic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased linoleic acid content of at least 4% when compared to the total fatty acid content and oleic acid content of a null segregant soybean seed.

Again in a further aspect, the present invention concerns a method for increasing the total fatty acid content and decreased palmitic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased palmitic acid content of at least 8% when compared to the total fatty acid content and oleic acid content of a null segregant soybean seed.

In yet another aspect, the present invention concerns a method for increasing the total fatty acid content and stearic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and an increased stearic acid content of at least 14% when compared to the total fatty acid content and oleic acid content of a null segregant soybean seed.

As was discussed above, any of the transgenic oilseeds discussed herein can comprise a recombinant construct having at least one DGAT sequence. This DGAT sequence can be selected from the group consisting of DGAT1, DGAT2, or DGAT1 in combination with DGAT2. Furthermore, at least one DGAT sequence can be a tree nut sequence, or a shuffled DGAT sequence.

Transformation of monocotyledons using electroporation, particle bombardment, and *Agrobacterium* have been reported. Transformation and plant regeneration have been achieved in asparagus (Bytebier et al., *Proc. Natl. Acad. Sci.* (USA) 84:5354, (1987)); barley (Wan and Lemaux, Plant Physiol 104:37 (1994)); *Zea mays* (Rhodes et al., *Science* 240:204 (1988), Gordon-Kamm et al., *Plant Cell* 2:603-618 (1990), Fromm et al., *Bio/Technology* 8:833 (1990), Koziel et al., *Bio/Technology* 11: 194, (1993), Armstrong et al., *Crop Science* 35:550-557 (1995)); oat (Somers et al., *Bio/Technology* 10: 15 89 (1992)); orchard grass (Horn et al., *Plant Cell Rep.* 7:469 (1988)); rice (Toriyama et al., *Theor Appl. Genet.* 205:34, (1986); Part et al., *Plant Mol. Biol.* 32:1135-1148, (1996); Abedinia et al., *Aust. J. Plant Physiol.* 24:133-141 (1997); Zhang and Wu, *Theor. Appl. Genet.* 76:835 (1988); Zhang et al. *Plant Cell Rep.* 7:379, (1988); Battraw and Hall, Plant Sci. 86:191-202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)), and wheat (Vasil et al., *Bio/Technology* 10:667 (1992); U.S. Pat. No. 5,631,152).

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988); Marcotte et al., *Plant Cell* 1:523-532 (1989); McCarty et al., *Cell* 66:895-905 (1991); Hattori et al., *Genes Dev.* 6:609-618 (1992); Goff et al., *EMBO J.* 9:2517-2522 (1990)).

Transient expression systems may be used to functionally dissect gene constructs (see generally, Maliga et al., Methods in Plant Molecular Biology, Cold Spring Harbor Press (1995)). It is understood that any of the nucleic acid molecules of the present invention can be introduced into a plant cell in a permanent or transient manner in combination with other genetic elements such as vectors, promoters, enhancers etc.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., Molecular Cloning: A Laboratory Manual, Cold Spring Harbor Press (1989); Maliga et al., Methods in Plant Molecular Biology, Cold Spring Harbor Press (1995); Birren et al., Genome Analysis: Detecting Genes, 1, Cold Spring Harbor, N.Y. (1998); Birren et al., Genome Analysis Analyzing DNA, 2, Cold Spring Harbor, N.Y. (1998); Plant Molecular Biology: A Laboratory Manual, eds. Clark, Springer, N.Y. (1997)).

The transgenic soybean seeds of the invention can be processed to yield soy oil, soy products and/or soy by-products.

"Soy products" can include, but are not limited to, those items listed in Table 1A.

TABLE 1A

Soy Protein Products Derived from Soybean Seeds[a]

Whole Soybean Products

Roasted Soybeans
Baked Soybeans
Soy Sprouts
Soy Milk
   Specialty Soy Foods/Ingredients Soy Milk
Tofu
Tempeh
Miso
Soy Sauce
Hydrolyzed Vegetable Protein
Whipping Protein
   Processed Soy Protein Products Full Fat and Defatted Flours
Soy Grits
Soy Hypocotyls
Soybean Meal
Soy Milk
Soy Protein Isolates
Soy Protein Concentrates
Textured Soy Proteins
Textured Flours and Concentrates
Textured Concentrates
Textured Isolates

[a]See Soy Protein Products: Characteristics, Nutritional Aspects and Utilization (1987). Soy Protein Council.

"Processing" refers to any physical and chemical methods used to obtain the products listed in Table 1A and includes, but is not limited to, heat conditioning, flaking and grinding, extrusion, solvent extraction, or aqueous soaking and extraction of whole or partial seeds. Furthermore, "processing" includes the methods used to concentrate and isolate soy protein from whole or partial seeds, as well as the various traditional Oriental methods in preparing fermented soy food products. Trading Standards and Specifications have been established for many of these products (see National Oilseed Processors Association Yearbook and Trading Rules 1991-1992). Products referred to as being "high protein" or "low protein" are those as described by these Standard Specifications. "NSI" refers to the Nitrogen Solubility Index as defined by the American Oil Chemists' Society Method Ac4 41. "KOH Nitrogen Solubility" is an indicator of soybean meal quality and refers to the amount of nitrogen soluble in 0.036 M KOH under the conditions as described by Araba and Dale [(1990) Poult. Sci. 69:76-83]. "White" flakes refer to flaked, dehulled cotyledons that have been defatted and treated with controlled moist heat to have an NSI of about 85 to 90. This term can also refer to a flour with a similar NSI that has been ground to pass through a No. 100 U.S. Standard Screen size. "Cooked" refers to a soy protein product, typically a flour, with an NSI of about 20 to 60. "Toasted" refers to a soy protein product, typically a flour, with an NSI below 20. "Grits" refer to defatted, dehulled cotyledons having a U.S. Standard screen size of between No. 10 and 80. "Soy Protein Concentrates" refer to those products produced from dehulled, defatted soybeans by three basic processes: acid leaching (at about pH 4.5), extraction with alcohol (about 55-80%), and denaturing the protein with moist heat prior to extraction with water. Conditions typically used to prepare soy protein concentrates have been described by Pass [(1975) U.S. Pat. No. 3,897,574; Campbell et al., (1985) in New Protein Foods, ed. by Altschul and Wilcke, Academic Press, Vol. 5, Chapter 10, Seed Storage Proteins, pp 302-338]. "Extrusion" refers to processes whereby material (grits, flour or concentrate) is passed through a jacketed auger using high pressures and temperatures as a means of altering the texture of the material. "Texturing" and "structuring" refer to extrusion processes used to modify the physical characteristics of the material. The characteristics of these processes, including thermoplastic extrusion, have been described previously [Atkinson (1970) U.S. Pat. No. 3,488,770, Horan (1985) In New Protein Foods, ed. by Altschul and Wilcke, Academic Press, Vol. 1A, Chapter 8, pp 367-414]. Moreover, conditions used during extrusion processing of complex foodstuff mixtures that include soy protein products have been described previously [Rokey (1983) Feed Manufacturing Technology III, 222-237; McCulloch, U.S. Pat. No. 4,454,804].

TABLE 1B

Generalized Steps for Soybean Oil and Byproduct Production

| Process Step | Process | Impurities Removed and/or By-Products Obtained |
|---|---|---|
| #1 | soybean seed | |
| #2 | oil extraction | meal |
| #3 | Degumming | lecithin |
| #4 | alkali or physical refining | gums, free fatty acids, pigments |
| #5 | water washing | soap |
| #6 | Bleaching | color, soap, metal |
| #7 | (hydrogenation) | |
| #8 | (winterization) | stearine |
| #9 | Deodorization | free fatty acids, tocopherols, sterols, volatiles |
| #10 | oil products | |

More specifically, soybean seeds are cleaned, tempered, dehulled, and flaked, thereby increasing the efficiency of oil extraction. Oil extraction is usually accomplished by solvent (e.g., hexane) extraction but can also be achieved by a combination of physical pressure and/or solvent extraction. The resulting oil is called crude oil. The crude oil may be degummed by hydrating phospholipids and other polar and neutral lipid complexes that facilitate their separation from the nonhydrating, triglyceride fraction (soybean oil). The resulting lecithin gums may be further processed to make commercially important lecithin products used in a variety of food and industrial products as emulsification and release (i.e., antisticking) agents. Degummed oil may be further refined for the removal of impurities (primarily free fatty acids, pigments and residual gums). Refining is accomplished by the addition of a caustic agent that reacts with free fatty acid to form soap and hydrates phosphatides and proteins in the crude oil. Water is used to wash out traces of soap formed during refining. The soapstock byproduct may be used directly in animal feeds or acidulated to recover the free fatty acids. Color is removed through adsorption with a bleaching earth that removes most of the chlorophyll and carotenoid compounds. The refined oil can be hydrogenated, thereby resulting in fats with various melting properties and textures. Winterization (fractionation) may be used to remove stearine from the hydrogenated oil through crystallization under carefully controlled cooling conditions. Deodorization (principally via steam distillation under vacuum) is the last step and is designed to remove compounds which impart odor or flavor to the oil. Other valuable byproducts such as tocopherols and sterols may be removed during the deodorization process. Deodorized distillate containing these byproducts may be sold for production of natural vitamin E and other high-value pharmaceutical products. Refined, bleached, (hydrogenated, fractionated) and deodorized oils and fats may be packaged and sold directly or further processed into more specialized products. A more detailed reference to soybean seed processing, soybean oil production, and byproduct utilization can be found in Erickson, Practical Handbook of Soybean Processing and Utilization, The American Oil Chemists' Society and United Soybean Board (1995). Soybean oil is liquid at room temperature because it is relatively low in saturated fatty acids when compared with oils such as coconut, palm, palm kernel, and cocoa butter.

Plant and microbial oils containing PUFAs that have been refined and/or purified can be hydrogenated, thereby resulting in fats with various melting properties and textures. Many processed fats (including spreads, confectionary fats, hard butters, margarines, baking shortenings, etc.) require varying degrees of solidity at room temperature and can only be produced through alteration of the source oil's physical properties. This is most commonly achieved through catalytic hydrogenation.

Hydrogenation is a chemical reaction in which hydrogen is added to the unsaturated fatty acid double bonds with the aid of a catalyst such as nickel. For example, high oleic soybean oil contains unsaturated oleic, linoleic, and linolenic fatty acids, and each of these can be hydrogenated. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction, which in turn alter the composition of the final product. Operating conditions including pressure, temperature, catalyst type and concentration, agitation, and reactor design are among the more important parameters that can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings (used in the manufacture of baking products, solid fats and shortenings used for commercial frying and roasting operations) and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society (1994).

Hydrogenated oils have become somewhat controversial due to the presence of trans-fatty acid isomers that result from the hydrogenation process. Ingestion of large amounts of trans-isomers has been linked with detrimental health effects including increased ratios of low density to high density lipoproteins in the blood plasma and increased risk of coronary heart disease.

In another aspect the present invention concerns an isolated polynucleotide comprising:

(a) a nucleotide sequence encoding a polypeptide having diacylglycerol acyltransferase activity wherein the polypeptide has at least 80% amino acid identity, based on the Clustal V method of alignment, when compared to an amino acid sequence as set forth in SEQ ID NOs:8, 10, or 12;

(b) a nucleotide sequence encoding a polypeptide having diacylglycerol acyltransferase activity, wherein the nucleotide sequence has at least 80% sequence identity, based on the BLASTN method of alignment, when compared to a nucleotide sequence as set forth in SEQ ID NO: 7, 9, or 11:

(c) a nucleotide sequence encoding a polypeptide having diacylglycerol acyltransferase activity, wherein the nucleotide sequence hybridizes under stringent conditions to a nucleotide sequence as set forth in SEQ ID NO: 7, 9, or 11; or (d) a complement of the nucleotide sequence of (a), (b) or (c), wherein the complement and the nucleotide sequence consist of the same number of nucleotides and are 100% complementary.

The isolated polynucleotide may be obtained from one or more edible nuts, such as, but not limited to, hazelnut, hickory, pistachio, and pecan. The isolated polynucleotide may also be part of a recombinant DNA construct comprising at least one regulatory sequence. This recombinant construct may also be comprised in a cell. This cell may be from an oilseed plant. Suitable oilseed plants include, but are not limited to, soybean, corn, canola, sunflower, flax, cotton, and safflower.

In a further aspect the present invention concerns a method for increasing the total fatty acid content of an oilseed comprising:

(a) transforming at least one oilseed cell with the above mentioned recombinant construct;

(b) selecting the transformed oilseed cell(s) of step (a) having an increased total fatty acid content when compared to the total fatty acid content of a null segregant oilseed.

Polynucleotide sequences produced by diversity generation methods or recursive sequence recombination ("RSR") methods (e.g., DNA shuffling), which can be accomplished in vitro, in vivo, in silico, or a combination thereof are a feature of the invention. A diversification method can include recursively recombining one or more nucleotide sequences of the invention as described below with one or more additional nucleotides. The recombining steps are optionally performed in vivo, ex vivo, in silico or in vitro. This diversity generation or recursive sequence recombination produces at least one library of recombinant modified DGAT polynucleotides. Polypeptides encoded by members of this library are included in the invention. These polypeptides can be referred to, but are not limited to, terms such as "shuffled DGATs", modified Type I diacylglycerol acyltransferase", "modified DGATs", or "DGAT sequences containing amino acid substitutions resulting in oil increases".

DGATs of the present invention can be readily modified using methods that are well known in the art to improve or alter DGAT activity. A variety of diversity generating protocols are available and described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, nucleic acid libraries) which are useful for the engineering or rapid evolution of nucleic acids, proteins, pathways, cells and/or organisms with new and/or improved characteristics.

While distinctions and classifications are made in the course of the ensuing discussion for clarity; it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids that encode proteins with or which confer desirable properties. Following diversification by one or more of the methods herein, or otherwise available to one of skill, any nucleic acids that are produced can be selected for a desired activity or property, e.g. DGAT activity. A variety of related (or even unrelated) properties can be evaluated, in serial or in parallel, at the discretion of the practitioner.

Descriptions of a variety of diversity generating procedures, including multigene shuffling and methods for generating modified nucleic acid sequences encoding multiple enzymatic domains, are found in, e.g., the following publications and the references cited therein: Soong, N. et al. (2000) "Molecular breeding of viruses" Nat Genet. 25(4):436-39; Stemmer, et al. (1999) "Molecular breeding of viruses for targeting and other clinical properties" Tumor Targeting 4:1-4; Ness et al. (1999) "DNA Shuffling of subgenomic sequences of subtilisin" Nature Biotechnology 17:893-896; Chang et al. (1999) "Evolution of a cytokine using DNA family shuffling" Nature Biotechnology 17:793-797; Minshull and Stemmer (1999) "Protein evolution by molecular breeding" Current Opinion in Chemical Biology 3:284-290; Christians et al. (1999) "Directed evolution of thymidine kinase for AZT phosphorylation using DNA family shuffling" Nature Biotechnology 17:259-264; Crameri et al. (1998) "DNA shuffling of a family of genes from diverse species accelerates directed evolution" Nature 391:288-291; Crameri et al. (1997) "Molecular evolution of an arsenate detoxification pathway by DNA shuffling," Nature Biotechnology 15:436-438; Zhang et al. (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Crameri et al. (1996) "Improved green fluorescent protein by molecular evolution using DNA shuffling" Nature Biotechnology 14:315-319; Gates et al. (1996) "Affinity selective isolation of ligands from peptide libraries through display on a lac repressor 'headpiece dimer'" Journal of Molecular Biology 255:373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al., (1995) "Single-step assembly of a gene and entire plasmid from large numbers of oligodeoxy-ribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Additional details regarding various diversity generating methods can be found in, e.g., the following U.S. patents, PCT publications, and EPO publications: U.S. Pat. Nos. 5,605,793, 5,811,238, 5,830,721, 5,834,252, and 5,837,458; WO 95/22625; WO 96/33207; WO 97/20078; WO 97/35966; WO 99/41402; WO 99/41383; WO 99/41369; WO 99/41368; EP 752008; EP 0932670; WO 99/23107; WO 99/21979; WO 98/31837; WO 98/27230; WO 98/13487; WO 00/00632; WO 00/09679; WO 98/42832; WO 99/29902; WO 98/41653; WO 98/41622; WO 98/42727; WO 00/18906; WO 00/04190; WO 00/42561; WO 00/42559; WO 00/42560; WO 01/23401; and WO 01/64864.

Additional details regarding various diversity generating methods can be found in, e.g., U.S. patent application Ser. Nos. 09/407,800 and 60/186,482; U.S. Pat. Nos. 6,379,964, 6,376,246, 6,436,675, 6,642,426, and 7,024,312; WO 00/42561; WO 00/42560; and WO 00/42559.

In brief, several different general classes of sequence modification methods, such as mutation, recombination, etc. are set forth in the references above. Accordingly, the DGAT nucleic acids of the invention can be generated from wild type sequences. Moreover, the DGAT nucleic acid sequences of the invention can be modified to create modified sequences with the same or different activity.

Synthetic recombination methods can also be used, in which oligonucleotides corresponding to targets of interest are synthesized and reassembled in PCR or ligation reactions which include oligonucleotides which correspond to more than one parental nucleic acid, thereby generating new recombined nucleic acids. Oligonucleotides can be made by standard nucleotide addition methods, or can be made, e.g., by tri-nucleotide synthetic approaches. Details regarding such approaches are found in the references noted above, including, e.g., WO 00/42561, WO 01/23401, WO 00/42560, and WO 00/42559.

In silico methods of recombination can be effected in which genetic algorithms are used in a computer to recombine sequence strings which correspond to homologous (or even non-homologous) nucleic acids. The resulting recombined sequence strings are optionally converted into nucleic acids by synthesis of nucleic acids which correspond to the recombined sequences, e.g., in concert with oligonucleotide synthesis gene reassembly techniques. This approach can generate random, partially random or designed variants. Many details regarding in silico recombination, including the use of genetic algorithms, genetic operators and the like in computer systems, combined with generation of corresponding nucleic acids (and/or proteins), as well as combinations of designed nucleic acids and/or proteins (e.g., based on crossover site selection) as well as designed, pseudo-random or random recombination methods are described in WO 00/42560 and WO 00/42559. Extensive details regarding in silico recombination methods are found in these applications. This methodology is generally applicable to the present invention in providing for recombination of nucleic acid sequences and/or gene fusion constructs encoding DGAT proteins in silico and/or the generation of corresponding nucleic acids or proteins.

Many of the above-described methodologies for generating modified polynucleotides generate a large number of diverse variants of a parental sequence or sequences. In some preferred embodiments of the invention, the modification technique (e.g., some form of shuffling) is used to generate a library of variants that is then screened for a modified polynucleotide or pool of modified polynucleotides encoding some desired functional attribute, e.g., improved DGAT activity. Exemplary enzymatic activities that can be screened for include catalytic rates (conventionally characterized in terms of kinetic constants such as $k_{cat}$ and $K_M$), substrate specificity, and susceptibility to activation or inhibition by substrate, product or other molecules (e.g., inhibitors or activators).

In another aspect, the present invention concerns an isolated nucleic acid fragment, and methods of using said fragment, encoding a modified Type 1 diacylglycerol acyltransferase polypeptide such that the modified Type 1 diacylglycerol acyltransferase polypeptide has at least one amino acid substitution selected from the group consisting of: a non-alanine at a position corresponding to position 12 of SEQ ID NO:12 to alanine, a non-proline at a position corresponding to position 30 of SEQ ID NO:12 to proline, a non-alanine at a position corresponding to position 31 of SEQ ID NO:12 to alanine, a non-serine at a position corresponding to position 48 of SEQ ID NO:12 to serine, a non-serine at a position corresponding to position 49 of SEQ ID NO:12 to serine, a non-aspartate at a position corresponding to position 51 of SEQ ID NO:12 to aspartate, a non-aspartate at a position corresponding to position 52 of SEQ ID NO:12 to aspartate, a non-threonine at a position corresponding to position 59 of SEQ ID NO:12 to threonine, a non-threonine at a position corresponding to position 73 of SEQ ID NO:12 to threonine, a non-asparagine at a position corresponding to position 79 of SEQ ID NO:12 to sparagine, a non-leucine at a position corresponding to position 118 of SEQ ID NO:12 to leucine, a non-alanine at a position corresponding to position 123 of SEQ ID NO:12 to alanine, a non-valine at a position corresponding to position 128 of SEQ ID NO:12 to valine, a non-leucine at a position corresponding to position 139 of SEQ ID NO:12 to leucine, a non-isoleucine at a position corresponding to position 155 of SEQ ID NO:12 to isoleucine, a non-alanine at a position corresponding to position 181 of SEQ ID NO:12 to alanine, a non-serine at a position corresponding to position 184 of SEQ ID NO:12 to serine, a non-valine at a position corresponding to position 197 of SEQ ID NO:12 to valine, a non-valine at a position corresponding to position 198 of SEQ ID NO:12 to valine, a non-methionine at a position corresponding to position 205 of SEQ ID NO:12 to methionine, a non-threonine at a position corresponding to position 211 of SEQ ID NO:12 to threonine, a non-histidine at a position corresponding to position 218 of SEQ ID NO:12 to histidine, a non-valine at a position corresponding to position 222 of SEQ ID NO:12 to valine, a non-lysine at a position corresponding to position 241 of SEQ ID NO:12 to lysine, a non-valine at a position corresponding to position 247 of SEQ ID NO:12 to valine, a non-valine at a position corresponding to position 251 of SEQ ID NO:12 to valine, a non-serine at a position corresponding to position 256 of SEQ ID NO:12 to serine, a non-serine at a position corresponding to position 257 of SEQ ID NO:12 to serine, a non-phenylalanine at a position corresponding to position 266 of SEQ ID NO:12 to henylalanine, a non-alanine at a position corresponding to position 267 of SEQ ID NO:12 to alanine, a non-glutamate at a position corresponding to position 281 of SEQ ID NO:12 to glutamate, a non-aspartate at a position corresponding to position 288 of SEQ ID NO:12 to aspartate, a non-glutamate at a position corresponding to position 293 of SEQ ID NO:12 to glutamate, a non-asparagine at a position corresponding to position 294 of SEQ ID NO:12 to asparagine, a non-threonine at a position corresponding to position 299 of SEQ ID NO:12 to threonine, a non-asparagine at a position corresponding to position 301 of SEQ ID NO:12 to asparagine, a non-leucine at a position corresponding to position 308 of SEQ ID NO:12 to leucine, a non-glycine at a position corresponding to position 327 of SEQ ID NO:12 to glycine, a non-leucine at a position corresponding to position 329 of SEQ ID NO:12 to leucine, a non-leucine at a position corresponding to position 334 of SEQ ID NO:12 to leucine, a non-valine at a position corresponding to position 337 of SEQ ID NO:12 to valine, a non-valine at a position corresponding to position 338 of SEQ ID NO:12 to valine, a non-glutamine at a position corresponding to position 356 of SEQ ID NO:12 to glutamine, a non-asparagine at a position corresponding to position 363 of SEQ ID NO:12 to asparagine, a non-serine at a position corresponding to position 390 of SEQ ID NO:12 to serine, a non-valine at a position corresponding to position 399 of SEQ ID NO:12 to valine, a non-isoleucine at a position corresponding to position 436 of SEQ ID NO:12 to isoleucine, a non-alanine at a position corresponding to position 451 of SEQ ID NO:12 to alanine, a non-serine at a position corresponding to position 457 of SEQ ID NO:12 to serine, a non-methionine at a position corresponding to position 475 of SEQ ID NO:12 to methionine, a non-phenylalanine at a position corresponding to position 486 of SEQ ID NO:12 to phenylalanine, a non-isoleucine at a position corresponding to position 488 of SEQ ID NO:12 to isoleucine, a non-leucine at a position corresponding to position 491 of SEQ ID NO:12 to leucine, a non-lysine at a position corresponding to position 502 of SEQ ID NO:12 to lysine, a non-serine at a position corresponding to position 514 of SEQ ID NO:12 to serine, a non-valine at a position corresponding to position 518 of SEQ ID NO:12 to valine, and a non-valine at a position corresponding to position 531 of SEQ ID NO:12 to valine, when compared to the unmodified Type 1 diacylglycerol acyltransferase polypeptide, wherein the position corresponding to a position of SEQ ID NO:12 is based on an alignment using Clustal V of SEQ ID NO:12 and the unmodified Type 1 diacylglycerol acyltransferase polypeptide.

Furthermore, the present invention also concerns an isolated nucleic acid fragment, and methods of using said isolated nucleic acid fragment, encoding a modified Type 1 diacylglycerol acyltransferase polypeptide such that the modified Type 1 diacylglycerol acyltransferase polypeptide has at least one amino acid substitution selected from the group consisting of: a non-alanine at a position corresponding to position 24 of SEQ ID NO:153 to alanine, a non-asparagine at a position corresponding to position 58 of SEQ ID NO:153 to asparagine, a non-alanine at a position corresponding to position 146 of SEQ ID NO:153 to alanine, a non-methionine at a position corresponding to position 170 of SEQ ID NO:153 to methionine, a non-lysine at a position corresponding to position 206 of SEQ ID NO:153 to lysine, a non-valine at a position corresponding to position 216 of SEQ ID NO:153 to valine, a non-phenylalanine at a position corresponding to position 231 of SEQ ID NO:153 to phenylalanine, a non-glutamate at a position corresponding to position 258 of SEQ ID NO:153 to glutamate, a non-threonine at a position corresponding to position 264 of SEQ ID NO:153 to threonine, a non-leucine at a position corresponding to position 273 of SEQ ID NO:153 to leucine, a non-leucine at a position corresponding to position 299 of SEQ ID NO:153 to leucine, a non-valine at a position corresponding to position 303 of SEQ ID NO:153 to valine, a non-serine at a position corresponding to position 355 of SEQ ID NO:153 to serine, a non-valine at a position corresponding to position 364 of SEQ ID NO:153 to valine, a non-arginine at a position corresponding to position 401 of SEQ ID NO:153 to arginine, a non-serine at a position corresponding to position 422 of SEQ ID NO:153 to serine, a non-methionine at a position corresponding to position 440 of SEQ ID NO:153 to methionine, a non-lysine at a position corresponding to position 467 of SEQ ID NO:153 to lysine, a non-serine at a position corresponding to position 479 of SEQ ID NO:153 to serine, a non-valine at a position corresponding to position 483 of SEQ ID NO:153 to valine, when compared to the unmodified Type 1 diacylglycerol acyltransferase polypeptide, wherein the position corresponding to a position of SEQ ID NO:153 is based on an alignment using Clustal V of SEQ ID NO:153 and the unmodified Type 1 diacylglycerol acyltransferase polypeptide.

It is appreciated the present invention includes plants and progeny incorporating the above mentioned isolated nucleic acid. Other changes in amino acid positions that may contribute to creating a DGAT polypeptide that can results in increased fatty acid levels in plants can be found in the shuffled hazelnut sequences (SEQ ID NOs:25-150), the altered maize DGATs (SEQ ID NOs:163-170), and the altered soybean DGATs (SEQ ID NOs:152-161 and 184-195). Any one, any combination, or all of these changes are useful for making an altered DGAT that, when expressed in a plant, results in increased oil accumulation. Preferred embodiments of the invention would include, but are not limited to, at least 1, 2, 3, 4, 5, 6, 7, 8, 9, 10, 11, 12, 13, 14, 15, 16, 17, 18, 19, or 20 amino acid changes within a DGAT polypeptide, at the positions mentioned above.

In a final aspect the present invention concerns a fungal cell, or oleaginous microbial organism, comprising a recombinant DNA construct comprising any isolated nucleic acid fragment encoding any diacylglycerol acyltransferase of the present invention. Further, the fungal cell can be, but is not limited to, *Yarrowia, Candida, Rhodotorula, Rhodosporidium, Cryptococcus, Trichosporon* and *Lipomyces*.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

The meaning of abbreviations is as follows: "sec" means second(s), "min" means minute(s), "h" means hour(s), "d" means day(s), "µL" means microliter(s), "mL" means milliliter(s), "L" means liter(s), "µM" means micromolar, "mM" means millimolar, "M" means molar, "mmol" means millimole(s), "µmole" mean micromole(s), "g" means gram(s), "µg" means microgram(s), "ng" means nanogram(s), "U" means unit(s), "bp" means base pair(s) and "kB" means kilobase(s).

Example 1

Cloning Type I DGAT cDNAs from Hickory and Hazelnut

Developing nuts from hickory (*Carya ovata*), and hazelnut (*Corylus americana*), were harvested. The shells were cracked open, and the edible portion was removed and quickly frozen in liquid nitrogen, followed by further storage in a −80° C. freezer until needed. The frozen material from one nut each of hickory and hazelnut were ground separately under liquid nitrogen with a mortar and pestle. Total RNA was isolated from each by using a Purescript RNA kit from Gentra Systems (since purchased by Qiagen), and subsequently poly A RNA was isolated from hickory by using an mRNA kit from GE Biosciences. Using poly A RNA as template for hickory, and total RNA as template for hazelnut, first strand cDNA synthesis was done with a SuperScript III kit purchased from Invitrogen using oligo d(T) as primer and following the manufacturer's protocol.

To obtain partial length hickory and hazelnut DGAT cDNAs, PCR was performed with first strand cDNA as template, using primers P21 and P18 from conserved regions of known type I DGAT genes. The nucleotide sequence of forward primer P21 was 5'-CAAGGAGAGTCCGCTTAGCTC-3'. The nucleotide sequence of reverse primer P18 was 5'-CAGAAAATGAACCAGAAGATCATGTT-3'. The PCR was done using three cycles of 94° C. for 30 sec/43° C. for 30 sec/72° C. for 2 min, followed by 35 cycles of 94° C. for 30 sec/55° C. for 30 sec/72° C. for 2 min, followed by a final extension of 72° C. for 10 min. PCR products were sequenced to verify that they had sequence homology with known DGAT cDNAs.

The remainder of the DGAT coding regions were obtained with the 5' RACE and 3' RACE systems from Invitrogen, using gene specific primers according to the manufacturer's protocols. A final PCR was then done to amplify the entire coding region and to include restriction sites to facilitate cloning. The PCR was done using three cycles of 94° C. for 30 sec/43° C. for 30 sec/72° C. for 2 min, followed by 35 cycles of 94° C. for 30 sec/55° C. for 30 sec/72° C. for 2 min, followed by a final extension of 72° C. for 10 min. Nucleotide sequences of PCR primers used for hickory were: forward primer P33, 5'-TTTTGGATCCATGGCGATTTCGGATAT-GCCTG-3', and reverse primer P34, 5'-TTTTCCCGGGT-TATTCAGTCTGCCCTTTTCGGTTC-3'. Nucleotide sequences of PCR primers used for hazelnut were: forward primer P37b, 5'-TTTTAGATCTATGGCGATTTCGGATAT-GCCTGAAAGCACG-3', and reverse primer P38, 5'-TTTTCCCGGGTTATTCAGTCTTCCCTT-TACGGTTCATC-3'. The resulting PCR products containing the entire coding region were digested by BamH I and Sma I for hickory, or Bgl II and Sma I for hazelnut, and ligated into the BamH I and Sma I sites of the yeast expression vector pSZ378 (SEQ ID NO: 22, and FIG. 1). The pSZ378 vector was made by purchasing pRS426 from Stratagene, and adding regions of approximately 1.0 kb promoter and 0.5 kb terminator of the *S. cerevisiea* PGK1 gene that encodes 3-phosphoglycerate kinase. This vector may also be used to transform *E. coli* for routine plasmid DNA preparations, but not for DGAT expression.

Two closely related hickory DGAT cDNAs, and one hazelnut DGAT cDNA were obtained and named CO-DGAT1a, CO-DGAT1 b, and CA-DGAT1, respectively. The corresponding nucleotide sequences are SEQ ID NOs: 7, 9, and 11, respectively. The corresponding amino acid sequences are SEQ ID NOs: 8, 10, and 12, respectively. The corresponding plasmid names for the DGAT genes (the terms "gene" and "cDNA" are used interchangeably in these EXAMPLES) following ligation into the yeast expression vector are PHP32238 (SEQ ID NO: 13), PHP 32396 (SEQ ID NO: 14), and PHP32395 (SEQ ID NO: 15), respectively. The amino acid sequence identities were analyzed for the edible nut DGATs and for other type I DGATs from soybean (SEQ ID NO: 16, PCT Pub WO 00/32756), Arabidopsis (SEQ ID NO: 17, accession # CAB45373), wheat (SEQ ID NO:18, PCT Pub WO 00/32756), and maize (SEQ ID NO:19, accession # EU039830, presented in Nature Genetics 40:367-372) using the Clustal V sequence alignment program (Table 2). The two hickory DGAT sequences differ by only 3 amino acids.

TABLE 2

DGAT Amino Acid Sequence Identities (%)

| | Hickory (CO-DGAT1a) | Hickory (CO-DGAT1b) | Hazelnut (CA-DGAT1) | Soy | Arab. | Wheat | Maize |
|---|---|---|---|---|---|---|---|
| Hickory (CO-DGAT1a) | 100 | 99 | 83 | 73 | 66 | 65 | 66 |
| Hickory (CO-DGAT1b) | | 100 | 83 | 73 | 66 | 64 | 66 |
| Hazelnut (CA-DGAT1) | | | 100 | 76 | 67 | 64 | 64 |
| Soy | | | | 100 | 66 | 61 | 63 |
| Arab. | | | | | 100 | 59 | 61 |
| Wheat | | | | | | 100 | 74 |
| Maize | | | | | | | 100 |

Example 2

Expression of Hickory and Hazelnut DGAT cDNAs in Yeast and Determination of DGAT Activity A double null Saccharomyces cerevisiae strain with deletions of the DGA1 gene that encodes DGAT and the LRO1 gene that encodes phospholipid:diacylglycerol acyltransferase (PDAT) was created as an oil deficient strain suitable for ectopic expression of DGAT cDNAs from hazelnut and hickory. The double null strain was made by purchasing the strain deficient in the DGA1 (DGAT) gene from Invitrogen (Clone ID: 12501) and then removing the LRO1 (PDAT) gene using homologous recombination.

Microsomal membrane preparations from yeast cultures transformed with the hazel and hickory DGAT expression vectors PHP32238, PHP32396, and PHP32395, and with the no DGAT control vector pSZ378, were used for DGAT activity assays. For microsomal membrane preparations, the method of Milcamps et al, J Biol Chem 280:5370-5377, was followed, with minor changes. Saccharomyces ceriviseae cultures were grown to early stationary phase in 100 ml of SC media minus uracil (20 g glucose, 6.7 g Difco yeast N base w/o amino acids, and 0.77 g-Ura DO supplement/liter). Following harvest, the yeast pellets were resuspended in 4 ml of 20 mM Tris-HCl, pH 8, 10 mM $MgCl_2$, 1 mM EDTA, 5% glycerol, 1 mM DTT, and 0.3 M $(NH_4)_2SO_4$. Two ml of glass beads (425-600 µm, Sigma catalog #G8772) were added, and cells were lysed by vortexing for 5 min. The lysate was centrifuged for 15 min at 1500 g at 6° C. The supernatant was then centrifuged at 100,000 g for 1.5 h at 6° C. The microsomal pellet was resuspended in 500 µl of 100 mM potassium phosphate (pH 7.2) containing 10% glycerol, and frozen in liquid nitrogen prior to storage at −80° C. Protein concentrations were determined by the method of Bradford, using the Coomassie Plus reagent (Pierce), with bovine serum albumin as standard.

DGAT assays were done for 1 min at 25° C. with 50 mM potassium phosphate pH 7.2, 10 µM 10 µM 1-$^{14}$C-labelled oleoyl-coenzyme A (Perkin Elmer), and 20 µg of microsomal protein, using endogenous diacylglycerol, in a total reaction volume of 100 µl. The reaction was started by addition of the microsomal membranes to the remainder of the reaction components. The assay was stopped and lipids were extracted with 2 ml of hexane:isopropanol (3:2) (Hara and Radin, Anal. Biochem. 90:420-426) containing 4 µl of unlabeled triacylglycerol (triolein, Sigma catalog #T7140). Following vortexing for 10 s, the phases were separated with 1 ml of 500 mM sodium sulfate and vortexing was again done for 10 s. After 10 m, the upper phase was transferred to another tube and dried with nitrogen gas. The lipid was resolubilized in a small volume of hexane (approximately 100 to 150 µl) and applied to K6 silica TLC plates, which were developed in 80:20:1 (v/v) hexane:diethylether:acetic acid. Triacylglycerol was visualized and marked by staining in iodine vapor. After the stain faded, the triacylglycerol was scraped, and radioactivity was determined by liquid scintillation counting.

All three DGAT cDNAs were functional (TABLE 3), as indicated by much greater activity than observed for the vector control.

TABLE 3

DGAT Activity Following Expression in Yeast

| DGAT cDNA expressed in Saccharomyces cerevisiae DGAT/PDAT null | DGAT Activity (pmol C14-labeled oleoyl-CoA incorporated into TAG per min per mg microsomal protein). Mean ± SD of duplicate assays. |
|---|---|
| Hazelnut (CA-DGAT1) | 3622 ± 208 |
| Hickory (CO-DGAT1a) | 3004 ± 190 |
| Hickory (CO-DGAT1b) | 2905 ± 143 |
| Vector control (no DGAT) | 16.7 ± 3.9 |

Example 3

Expression of CA-DGAT1 in Soybean Somatic Embryos Increases Oil Content and Oleic Acid Content A soybean transformation vector KS 394 (SEQ ID NO: 20) was constructed that included the promoter from the soybean β-conglycinin α' subunit (Beachy et al., *EMBO J.* 4:3047-3053) driving expression of the wild type hazel DGAT cDNA CA-DGAT1. A control vector KS352 (SEQ ID NO: 21) that contained no DGAT genes was also constructed.

Soybean embryogenic suspension cultures were transformed with intact plasmid DNA of KS 394 or KS 352 by the method of particle gun bombardment (Klein et al., *Nature* 327:70 (1987)) using a DuPont Biolistic PDS1000/HE instrument (helium retrofit). The tissue culture and transformation methods are described in more detail as follows:

Culture Conditions:

Soybean embryogenic suspension cultures (cv. Jack) were maintained in 35 mL liquid medium SB196 (infra) on a rotary shaker, 150 rpm, 26° C. with cool white fluorescent lights on 16:8 h day/night photoperiod at light intensity of 60-85 µE/m2/s. Cultures were subcultured every 7 days to two weeks by inoculating approximately 35 mg of tissue into 35 mL of fresh liquid SB196 (the preferred subculture interval is every 7 days).

Soybean Embryogenic Suspension Culture Initiation:

Soybean cultures were initiated twice each month with 5-7 days between each initiation. Pods with immature seeds from available soybean plants 45-55 days after planting were picked, removed from their shells and placed into a sterilized magenta box. The soybean seeds were sterilized by shaking them for 15 min in a 5% Clorox solution with 1 drop of ivory soap (i.e., 95 mL of autoclaved distilled water plus 5 mL Clorox and 1 drop of soap, mixed well). Seeds were rinsed using 2 1-liter bottles of sterile distilled water and those less than 4 mm were placed on individual microscope slides. The small end of the seed was cut and the cotyledons pressed out of the seed coat. Cotyledons were transferred to plates containing SB199 medium (25-30 cotyledons per plate) for 2 weeks, then transferred to SB1 for 2-4 weeks. Plates were wrapped with fiber tape. After this time, secondary embryos were cut and placed into SB196 liquid media for 7 days.

Preparation of DNA for Bombardment:

A 50 µL aliquot of sterile distilled water containing 1 mg of gold particles was added to 5 µL of a 1 µg/µL DNA solution, 50 µL 2.5M $CaCl_2$ and 20 µL of 0.1 M spermidine. The mixture was pulsed 5 times on level 4 of a vortex shaker and spun for 5 sec in a bench microfuge. After a wash with 150 µL of 100% ethanol, the pellet was suspended by sonication in 85 µL of 100% ethanol. Five µL of DNA suspension was dispensed to each flying disk of the Biolistic PDS1000/HE instrument disk. Each 5 µL aliquot contained approximately 0.058 mg gold particles per bombardment (i.e., per disk).

Tissue Preparation and Bombardment with DNA:

Approximately 100-150 mg of 7 day old embryonic suspension cultures were placed in an empty, sterile 60×15 mm petri dish and the dish was placed inside of an empty 150×25 mm Petri dish. Tissue was bombarded 1 shot per plate with membrane rupture pressure set at 650 PSI and the chamber was evacuated to a vacuum of 27-28 inches of mercury. Tissue was placed approximately 2.5 inches from the retaining/stopping screen.

Selection of Transformed Embryos:

Transformed embryos were selected using hygromycin as the selectable marker. Specifically, following bombardment, the tissue was placed into fresh SB196 media and cultured as described above. Six to eight days post-bombardment, the SB196 is exchanged with fresh SB196 containing 30 mg/L hygromycin. The selection media was refreshed weekly. Four to six weeks post-selection, green, transformed tissue was observed growing from untransformed, necrotic embryogenic clusters. Isolated, green tissue was removed and inoculated into multi-well plates to generate new, clonally propagated, transformed embryogenic suspension cultures.

Embryo Maturation:

Transformed embryogenic clusters were cultured for one-three weeks at 26° C. in SB196 under cool white fluorescent (Phillips cool white Econowatt F40/CW/RS/EW) and Agro (Phillips F40 Agro) bulbs (40 watt) on a 16:8 hrphotoperiod with light intensity of 90-120 $E/m^2$ s. After this time embryo clusters were removed to a solid agar media, SB166, for 1 week, and then subcultured to medium SB103 for 3 weeks. Alternatively, embryo clusters were removed to SB228 (SHaM) liquid media, 35 mL in 250 mL Erlenmeyer flask, for 2-3 weeks. Tissue cultured in SB228 was maintained on a rotary shaker, 130 rpm, 26° C. with cool white fluorescent lights on 16:8 h day/night photoperiod at light intensity of 60-85 µE/m2/s. During this period, individual embryos were removed from the clusters and screened for alterations in their fatty acid compositions.

Media Recipes:

SB 196—FN Lite Liquid Proliferation Medium (Per Liter)

| | |
|---|---|
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |
| 2,4-D (10 mg/L final concentration) | 1.0 mL |
| $KNO_3$ | 2.83 gm |
| $(NH_4)_2SO_4$ | 0.463 gm |
| Asparagine | 1.0 gm |
| Sucrose (1%) | 10 gm |
| pH 5.8 | |

FN Lite Stock Solutions

| Stock Number | | 1000 mL | 500 mL |
|---|---|---|---|
| 1 | MS Fe EDTA 100x Stock | | |
| | $Na_2$ EDTA* | 3.724 g | 1.862 g |
| | $FeSO_4$—$7H_2O$ | 2.784 g | 1.392 g |
| 2 | MS Sulfate 100x stock | | |
| | $MgSO_4$—$7H_2O$ | 37.0 g | 18.5 g |
| | $MnSO_4$—$H_2O$ | 1.69 g | 0.845 g |
| | $ZnSO_4$—$7H_2O$ | 0.86 g | 0.43 g |
| | $CuSO_4$—$5H_2O$ | 0.0025 g | 0.00125 g |
| 3 | FN Lite Halides 100x Stock | | |
| | $CaCl_2$—$2H_2O$ | 30.0 g | 15.0 g |
| | KI | 0.083 g | 0.0715 g |
| | $CoCl_2$—$6H_2O$ | 0.0025 g | 0.00125 g |
| 4 | FN Lite P, B, Mo 100x Stock | | |
| | $KH_2PO_4$ | 18.5 g | 9.25 g |
| | $H_3BO_3$ | 0.62 g | 0.31 g |
| | $Na_2MoO_4$—$2H_2O$ | 0.025 g | 0.0125 g |

*Add first, dissolve in dark bottle while stirring

SB1 Solid Medium (Per Liter)

1 package MS salts (Gibco/BRL-Cat. No. 11117-066)
1 mL B5 vitamins 1000× stock
31.5 g Glucose
2 mL 2,4-D (20 mg/L final concentration)
pH 5.7
8 g TC agar

SB199 Solid Medium (Per Liter)

1 package MS salts (Gibco/BRL-Cat. No. 11117-066)
1 mL B5 vitamins 1000× stock
30 g Sucrose
4 ml 2,4-D (40 mg/L final concentration)
pH 7.0
2 gm Gelrite

SB 166 Solid Medium (Per Liter)

1 package MS salts (Gibco/BRL-Cat. No. 11117-066)
1 mL B5 vitamins 1000× stock
60 g maltose
750 mg $MgCl_2$ hexahydrate
5 g Activated charcoal
pH 5.7
2 g Gelrite

SB 103 Solid Medium (Per Liter)

1 package MS salts (Gibco/BRL-Cat. No. 11117-066)
1 mL B5 vitamins 1000× stock
60 g maltose
750 mg $MgCl_2$ hexahydrate
pH 5.7
2 g Gelrite

SB 71-4 Solid Medium (Per Liter)

1 bottle Gamborg's B5 salts w/sucrose (Gibco/BRL-Cat. No. 21153-036)
pH 5.7
5 g TC agar

2,4-D Stock

Obtain premade from Phytotech Cat. No. D 295-concentration 1 mg/mL

B5 Vitamins Stock (per 100 mL)

Store aliquots at −20° C.
    10 g Myo-inositol
    100 mg Nicotinic acid
    100 mg Pyridoxine HCl
    1 g Thiamine
If the solution does not dissolve quickly enough, apply a low level of heat via the hot stir plate.

SB 228—Soybean Histodifferentiation & Maturation (SHaM) (Per Liter)

| | |
|---|---|
| DDI H2O | 600 ml |
| FN-Lite Macro Salts for SHaM 10X | 100 ml |
| MS Micro Salts 1000x | 1 ml |
| MS FeEDTA 100x | 10 ml |
| CaCl 100x | 6.82 ml |
| B5 Vitamins 1000x | 1 ml |
| L-Methionine | 0.149 g |
| Sucrose | 30 g |
| Sorbitol | 30 g |
| Adjust volume to 900 mL | |
| pH 5.8 | |
| Autoclave | |
| Add to cooled media (≦30 C.): | |
| *Glutamine (Final conc. 30 mM) 4% | 110 mL |

*Note:
Final volume will be 1010 mL after glutamine addition.

Because glutamine degrades relatively rapidly, it may be preferable to add immediately prior to using media. Expiration 2 weeks after glutamine is added; base media can be kept longer w/o glutamine.

FN-lite Macro for SHAM 10×—Stock #1 (Per Liter)

| | |
|---|---|
| $(NH_4)2SO_4$ (Ammonium Sulfate) | 4.63 g |
| $KNO_3$ (Potassium Nitrate) | 28.3 g |
| $MgSO_4*7H_2O$ (Magnesium Sulfate Heptahydrate) | 3.7 g |
| $KH_2PO_4$ (Potassium Phosphate, Monobasic) | 1.85 g |
| Bring to volume | |
| Autoclave | |

MS Micro 1000×—Stock #2 (Per 1 Liter)

| | |
|---|---|
| $H_3BO_3$ (Boric Acid) | 6.2 g |
| $MnSO_4*H_2O$ (Manganese Sulfate Monohydrate) | 16.9 g |
| $ZnSO4*7H20$ (Zinc Sulfate Heptahydrate) | 8.6 g |
| $Na_2MoO_4*2H20$ (Sodium Molybdate Dihydrate) | 0.25 g |
| $CuSO_4*5H_2O$ (Copper Sulfate Pentahydrate) | 0.025 g |
| $CoCl_2*6H_2O$ (Cobalt Chloride Hexahydrate) | 0.025 g |
| KI (Potassium Iodide) | 0.8300 g |
| Bring to volume | |
| Autoclave | |

FeEDTA 100×—Stock #3 (Per Liter)

| | |
|---|---|
| $Na_2EDTA$* (Sodium EDTA) | 3.73 g |
| $FeSO_4*7H_2O$ (Iron Sulfate Heptahydrate) | 2.78 g |
| *EDTA must be completely dissolved before adding iron. | |
| Bring to Volume | |
| Solution is photosensitive. Bottle(s) should be wrapped in foil to omit light. | |
| Autoclave | |

Ca 100×—Stock #4 (Per Liter)

| | |
|---|---|
| $CaCl_2*2H_2O$ (Calcium Chloride Dihydrate) | 44 g |
| Bring to Volume | |
| Autoclave | |

B5 Vitamin 1000×—Stock #5 (Per Liter)

| | |
|---|---|
| Thiamine * HCl | 10 g |
| Nicotinic Acid | 1 g |
| Pyridoxine * HCl | 1 g |
| Myo-Inositol | 100 g |
| Bring to Volume | |
| Store frozen | |

4% Glutamine-Stock #6 (Per Liter)

| | |
|---|---|
| DDI water heated to 30° C. | 900 ml |
| L-Glutamine | 40 g |
| Gradually add while stirring and applying low heat. | |
| Do not exceed 35° C. | |
| Bring to Volume | |
| Filter Sterilize | |
| Store frozen* | |

*Note:
Warm thawed stock in 31° C. bath to fully dissolve crystals.

Oil Analysis:

Somatic embryos were harvested after two weeks of culture in the liquid maturation medium SB228 (SHaM) liquid media. Approximately 60 and 30 events were created in transformations with KS352 and KS394, respectively. All embryos generated for a given event were harvested in bulk and processed as follows. Embryos were frozen on dry ice or by incubation in a −80° C. freezer for two h followed by lyophilization for 48 h.

Dried embryos were ground to a fine powder using a genogrinder vial (½"×2" polycarbonate) and a steel ball (SPEX Centriprep (Metuchen, N.J., U.S.A.). Grinding time was 30 sec at 1450 oscillations per min. For every event, triplicates of approximately 10 mg of tissue were weighed into Eppendorf tubes. The tissue was extracted using 200 µL heptane at room temperature under continuous shaking for 2 h. Heptane extracts were cleared by centrifugation and 25 L of extract was derivatized to fatty acid methyl esters as follows. One mL of a 25% sodium methoxide stock solution was added to 24 mL of HPLC grade methanol. Sodium methoxide was stored under an inert gas.

Five µL of a 17:0 TAG (Nu-Chek Prep, Elysian, Minn., USA) stock solution (10 mg/mL) was combined with 25 µL of heptane tissue extract in a glass culture tube, and 500 µL of 1% sodium methoxide was added. Samples were derivatized in a water bath at 50° C. for 15 min. Samples were allowed to cool to RT and 1 mL of 1 M NaCl was added followed by brief mixing. FAMEs were extracted into 1 mL of hepatene and 4 µL sample were quantitated by GC analysis.

Results of the oil analysis are presented in Tables 4 and 5. The mean fatty acid methyl ester content and oleic acid content of the embryos transformed with control vector KS 352 were 4.5% and 17.2%, respectively. The corresponding values for embryos transformed with the CA-DGAT1 vector KS 394 were 7.8% and 25.5%, respectively. These results demonstrate that expression of the CA-DGAT1 cDNA of hazelnut increases oil content and oleic acid content of soybean somatic embryos.

TABLE 4

Esterified Fatty Acid and Oleic Acid Content of Soybean Somatic Embryos Generated with the No DGAT Control Construct KS 352

| Event # | KS 352 FAME (% DCW) | oleic acid (% total FAME) |
|---|---|---|
| 22 | 6.2 | 18.9 |
| 16 | 5.7 | 15.8 |
| 35 | 5.6 | 19.5 |
| 48 | 5.6 | 18.5 |
| 14 | 5.5 | 17.3 |
| 43 | 5.5 | 18.7 |
| 42 | 5.4 | 19.3 |
| 33 | 5.3 | 17.2 |
| 68 | 5.3 | 18.6 |
| 3 | 5.2 | 18.5 |
| 4 | 5.2 | 18.9 |
| 11 | 5.2 | 19.1 |
| 41 | 5.2 | 16.9 |
| 51 | 5.2 | 18.2 |
| 7 | 5.1 | 17.2 |
| 10 | 5.1 | 19.9 |
| 21 | 5.1 | 18.2 |
| 27 | 5.1 | 18.3 |
| 1 | 5 | 17.6 |
| 46 | 5 | 18.4 |
| 59 | 5 | 17.5 |
| 66 | 5 | 19.3 |
| 5 | 4.9 | 15.1 |
| 15 | 4.9 | 15.7 |
| 29 | 4.9 | 16.5 |
| 2 | 4.8 | 17.6 |
| 9 | 4.8 | 17.4 |
| 30 | 4.8 | 17 |
| 34 | 4.8 | 16.9 |
| 19 | 4.7 | 14.8 |
| 47 | 4.7 | 17.4 |
| 67 | 4.7 | 22.9 |
| 13 | 4.6 | 17.2 |
| 28 | 4.6 | 15.9 |
| 39 | 4.6 | 18.6 |
| 44 | 4.6 | 17.1 |
| 65 | 4.6 | 19.4 |
| 6 | 4.5 | 13.9 |
| 24 | 4.5 | 16.1 |
| 31 | 4.5 | 15.9 |
| 20 | 4.4 | 17.1 |
| 37 | 4.4 | 17.3 |
| 69 | 4.4 | 19.2 |
| 50 | 4.3 | 17.2 |
| 54 | 4.3 | 19.5 |
| 55 | 4.3 | 16.1 |
| 64 | 4.3 | 18.7 |
| 32 | 4.1 | 14.4 |
| 61 | 4.1 | 16.8 |
| 23 | 4 | 16.1 |
| 26 | 4 | 13.6 |
| 49 | 4 | 16.5 |
| 18 | 3.9 | 16.4 |
| 8 | 3.8 | 15.5 |
| 53 | 3.8 | 20.2 |
| 63 | 3.8 | 17.2 |
| 52 | 3.7 | 17.3 |
| 17 | 3.6 | 14.3 |
| 36 | 3.6 | 15.7 |
| 60 | 3.4 | 16.6 |
| 12 | 3.3 | 15.4 |
| 45 | 3.3 | 15.2 |
| 62 | 3.3 | 18.8 |
| 40 | 3.2 | 13.3 |
| 25 | 3 | 12.3 |
| 38 | 3 | 16.2 |
| 57 | 2.5 | 18 |
| 56 | 2.3 | 18.2 |
| 58 | 2.2 | 16.5 |
| Mean | 4.5 | 17.2 |

TABLE 5

Esterified Fatty Acid and Oleic Acid Content of
Soybean Somatic Embryos Generated with the CA-DGAT1
Construct KS 394

| Event # | KS 394 FAME (% DCW) | oleic acid (% total FAME) |
|---|---|---|
| 2203.2.07 | 11.9 | 28.1 |
| 2203.1.02 | 10.3 | 29.2 |
| 2203.1.03 | 10.1 | 26.1 |
| 2203.2.17 | 9.1 | 28.2 |
| 2203.1.01 | 9.2 | 26.7 |
| 2203.2.13 | 8.8 | 29.0 |
| 2203.2.08 | 8.1 | 28.6 |
| 2203.2.09 | 8.3 | 27.5 |
| 2203.1.05 | 8.2 | 23.1 |
| 2203.2.01 | 9.1 | 20.4 |
| 2203.2.14 | 7.4 | 24.7 |
| 2203.2.12 | 8.0 | 26.4 |
| 2203.2.04 | 7.9 | 28.9 |
| 2203.2.02 | 8.3 | 29.3 |
| 2203.2.15 | 7.7 | 20.9 |
| 2203.4.03 | 7.4 | 24.3 |
| 2203.1.04 | 7.6 | 23.6 |
| 2203.1.06 | 7.8 | 25.3 |
| 2203.2.05 | 8.4 | 30.0 |
| 2203.2.03 | 8.0 | 27.9 |
| 2203.2.06 | 7.7 | 24.2 |
| 2203.2.16 | 7.5 | 26.3 |
| 2203.2.10 | 7.3 | 24.4 |
| 2203.4.07 | 6.9 | 26.4 |
| 2203.4.01 | 6.8 | 25.7 |
| 2203.1.07 | 6.6 | 25.2 |
| 2203.1.08 | 7.0 | 24.1 |
| 2203.2.11 | 6.6 | 23.2 |
| 2203.4.06 | 6.0 | 26.7 |
| 2203.4.05 | 6.2 | 18.9 |
| 2203.4.10 | 5.0 | 23.0 |
| 2203.5.01 | 5.1 | 20.9 |
| Mean | 7.8 | 25.5 |

Example 4

Creation and Identification of Novel DGAT Genes
that Give High Oil Content in Yeast Libraries of modified DGAT polynucleotides were generated using recursive sequence recombination methods (Stemmer, Proc. Natl. Acad. Sci. USA 91: 10747-10751; Ness et. al. Nature Biotechnology 20: 1251-1255). These libraries incorporated diversity from related enzymes and also incorporated random changes. The starting polynucleotide sequence in which the diversity was incorporated was CA-DGAT1* (SEQ ID No:23), which encodes the identical amino acid sequence as CA-DGAT1, and has a nearly identical nucleotide sequence as CA-DGAT1 except that internal BamH I and EcoR I restriction sites were removed to facilitate cloning. The CA-DGAT1* and novel DGAT genes were cloned into the unique BamH I and EcoR I restriction sites of the yeast expression vector pSZ378 described in Example 1. The CA-DGAT1* gene in the yeast expression vector is presented as SEQ ID NO: 24. Plasmid PHP35885 (SEQ ID NO: 151, FIG. 2) is a representative example of a novel DGAT gene, CA-DGAT1-C11, cloned into the yeast expression vector. The libraries of novel DGAT genes were amplified in E. coli and then transformed into the Saccharomyces cerevisiae DGAT/PDAT double null strain described in Example 2 using the transformation method of Giest and Schiestl (Nature Protocols 2:38-41) except that the heat shock was done at 37° C. rather than 42° C. High oil strains were identified by staining with the fluorescent stain Nile Red (Greenspan et al., J Cell Biol 100: 965-973). A wide variety of Nile Red staining conditions may be used successfully. For example, we usually stained for 5 min a 200 µl volume of a 1:10 dilution of a 2 day yeast culture grown in SC minus uracil media. The yeast was stained with 5 µl of a 0.02 mg/ml Nile Red stock dissolved in 95% ethanol. We then read fluorescence intensity using a 489 nm excitation wavelength and 581 nm emission wavelength. Fluorescence intensity was divided by absorbance at 600 nm to correct for differences in cell density. Examples of other conditions used successfully are 3 day cultures rather than 2 day, a 1:20 dilution of yeast rather than 1:10, staining for 10 min rather than 5 min, having the Nile Red stock dissolved in acetone or 25% DMSO rather than ethanol, and numerous different excitation and emission wavelengths.

Six libraries (libraries A through F) were initially generated and screened. A second round library J was then generated that combined diversity from some of the most promising novel DGATs obtained during the initial screening. The second round library was also amplified in E. coli, transformed into the Saccharomyces cerevisiae double null strain, and screened by Nile Red as described for the first round libraries. Additional rounds of library generation may include information obtained during the first and second rounds of screening as well as further diversity from related enzymes. The additional libraries may be made by continuing with the engineered CA-DGAT1* as backbone, or alternatively the diversity may be generated in a type I DGAT gene from maize, soybean, or another source.

Oil content (total fatty acid methyl esters as a percent of dry weight) and fatty acid composition were determined by quantitative gas chromatography for yeast strains with high Nile Red staining. Approximately 5-15 mg of yeast powder from 2 day cultures were weighed into the bottom of a 13×100 mm glass culture tube with screw cap and Teflon seal. 5 µL of a stock solution of 17:0 TAG (10 mg/mL in toluene) was added followed by addition of 500 µL 5% sulfuric acid in methanol (anhydrous). Samples were incubated at 95° C. for 1.5 h. Subsequently, tubes were allowed to cool to room temperature after which 1 ml of 1 M sodium chloride was added followed by mixing. One ml of heptane was added, contents were mixed and samples were spun briefly to mediate phase separation. Approximately 500 µl of the organic phase was transferred to a GC vial. Fatty acid methyl esters were analyzed by gas chromatography. Four I of heptane extract were analyzed on a Hewlett-Packard 6890 Gas Chromatograph fitted with an Omegawax 320 fused silica capillary column (Supelco Inc., Catalog No. 24152). The oven temperature was programmed to hold at 220° C. for 2.7 min, increase to 240° C. at 20 C/min and then hold for an additional 2.3 min. Carrier gas was supplied by a Whatman hydrogen generator. Retention times were compared to those for methyl esters of standards commercially available (Nu-Chek Prep, Inc. catalog #U-99-A).

Results of the oil analysis are presented in Tables 6, 7 and 8. Palmitic, palmitoleic, stearic, and oleic acid are abbreviated as 16:0, 16:1, 18:0, and 18:1, respectively. Higher oil content (total fatty acid methyl esters as a percent of dry weight) was present in many strains expressing novel DGATs in comparison with strains expressing either CA-DGAT1*, or a vector control. For unknown reasons, the entire data set of library J, including CA-DGAT1* controls, was lower than observed for the other libraries, but the novel DGATs from Library J still gave higher oil than did the CA-DGAT1* controls of this data set. The data of Tables 6, 7, and 8 confirmed that Nile Red staining is indeed effective in identifying high oil yeast strains, and that novel DGAT genes are more effective than CA-DGAT1* in increasing oil content in yeast.

TABLE 6

Oil Content and Fatty Acid Composition of Yeast Expressing Novel DGAT Genes from Libraries A, B, and C.

| DGAT expressed | FAME (% dry wt) | %16:0 | %16:1 | %18:0 | %18:1 |
|---|---|---|---|---|---|
| CA-DGAT1-A2 | 24.2 | 22.5 | 41.8 | 6.6 | 29.1 |
| CA-DGAT1-A3 | 20.8 | 23.0 | 41.8 | 6.9 | 28.4 |
| CA-DGAT1-C10 | 20.5 | 32.9 | 30.4 | 12.2 | 24.6 |
| CA-DGAT1-C8 | 20.5 | 31.5 | 31.0 | 12.2 | 25.3 |
| CA-DGAT1-C12 | 19.8 | 31.6 | 31.1 | 12.2 | 25.1 |
| CA-DGAT1-C9 | 19.5 | 31.8 | 31.1 | 12.3 | 24.8 |
| CA-DGAT1-C11 | 19.0 | 31.9 | 31.0 | 12.5 | 24.7 |
| CA-DGAT1-C13 | 18.5 | 31.8 | 31.0 | 12.6 | 24.6 |
| CA-DGAT1-C3 | 17.9 | 31.8 | 32.1 | 10.7 | 25.5 |
| CA-DGAT1-C15 | 17.6 | 33.0 | 30.9 | 12.2 | 23.9 |
| CA-DGAT1-A1 | 17.6 | 32.7 | 31.4 | 11.6 | 24.3 |
| CA-DGAT1-C7 | 17.5 | 31.8 | 30.8 | 12.6 | 24.8 |
| CA-DGAT1-C17 | 17.3 | 30.9 | 31.0 | 11.8 | 26.3 |
| CA-DGAT1-C1 | 16.5 | 33.5 | 30.3 | 12.9 | 23.2 |
| CA-DGAT1-A14 | 16.4 | 30.2 | 33.4 | 11.8 | 24.7 |
| CA-DGAT1-C18 | 16.3 | 30.7 | 30.9 | 11.4 | 26.9 |
| CA-DGAT1-C16 | 16.1 | 31.1 | 32.0 | 10.4 | 26.6 |
| CA-DGAT1-A9 | 15.7 | 29.5 | 32.5 | 12.3 | 25.7 |
| CA-DGAT1-B6 | 15.6 | 31.7 | 31.6 | 13.3 | 23.3 |
| CA-DGAT1-A16 | 15.3 | 30.4 | 33.0 | 11.8 | 24.8 |
| CA-DGAT1-A13 | 15.2 | 30.8 | 32.7 | 12.6 | 23.9 |
| CA-DGAT1-A15 | 15.0 | 30.2 | 34.1 | 10.0 | 25.7 |
| CA-DGAT1-A5 | 14.8 | 29.7 | 32.8 | 12.1 | 25.5 |
| CA-DGAT1-A7 | 14.8 | 29.1 | 32.5 | 12.4 | 26.0 |
| CA-DGAT1-A17 | 14.7 | 29.9 | 32.6 | 11.9 | 25.6 |
| CA-DGAT1-C5 | 14.4 | 30.6 | 29.9 | 12.2 | 27.3 |
| CA-DGAT1-C14 | 14.3 | 30.5 | 32.1 | 10.2 | 27.1 |
| CA-DGAT1-A10 | 14.2 | 30.9 | 32.4 | 11.9 | 24.7 |
| CA-DGAT1-A6 | 14.2 | 29.1 | 32.5 | 12.0 | 26.4 |
| CA-DGAT1-C6 | 14.1 | 30.0 | 26.9 | 14.4 | 28.7 |
| CA-DGAT1-A4 | 14.1 | 30.9 | 32.5 | 12.6 | 23.9 |
| CA-DGAT1-A21 | 13.6 | 30.5 | 33.7 | 10.5 | 25.3 |
| CA-DGAT1-A23 | 13.6 | 30.1 | 34.0 | 11.0 | 24.9 |
| CA-DGAT1-A22 | 13.5 | 29.8 | 34.1 | 10.8 | 25.3 |
| CA-DGAT1-A20 | 13.5 | 29.7 | 33.2 | 11.6 | 25.5 |
| CA-DGAT1-A24 | 13.5 | 29.8 | 32.8 | 11.9 | 25.4 |
| CA-DGAT1-A19 | 13.2 | 30.6 | 33.4 | 11.9 | 24.1 |
| CA-DGAT1-A12 | 13.2 | 29.9 | 33.0 | 11.2 | 25.9 |
| CA-DGAT1-A8 | 13.1 | 28.7 | 31.9 | 12.3 | 27.1 |
| CA-DGAT1-C2 | 13.0 | 29.3 | 28.5 | 13.7 | 28.4 |
| CA-DGAT1-A18 | 13.0 | 30.0 | 32.5 | 12.1 | 25.4 |
| CA-DGAT1* control, rep2 | 13.0 | 30.2 | 32.2 | 12.7 | 24.9 |
| C4 | 12.9 | 29.4 | 28.0 | 13.2 | 29.5 |
| B3 | 12.5 | 29.5 | 30.2 | 12.9 | 27.4 |
| A11 | 11.8 | 30.5 | 36.9 | 9.5 | 23.1 |
| B8 | 11.7 | 30.1 | 32.1 | 13.0 | 24.8 |
| B4 | 11.6 | 27.7 | 28.9 | 13.2 | 30.3 |
| CA-DGAT1* control, rep1 | 11.5 | 29.4 | 32.5 | 12.2 | 26.0 |
| CA-DGAT1-B2 | 10.6 | 27.2 | 29.3 | 13.1 | 30.4 |
| CA-DGAT1-B5 | 10.4 | 28.5 | 31.2 | 12.6 | 27.7 |
| CA-DGAT1-B1 | 10.3 | 22.3 | 33.2 | 12.0 | 32.5 |
| CA-DGAT1-B9 | 10.2 | 26.9 | 34.4 | 10.5 | 28.2 |
| Vector control | 3.1 | 18.9 | 39.9 | 13.8 | 27.4 |

TABLE 7

Oil Content and Fatty Acid Composition of Yeast Expressing Novel DGAT Genes from Libraries D, E, and F

| DGAT expressed | FAME (% dry wt) | %16:0 | %16:1 | %18:0 | %18:1 |
|---|---|---|---|---|---|
| CA-DGAT1-D2 | 19.3 | 32.6 | 31.1 | 12.2 | 23.4 |
| CA-DGAT1-E4 | 18.5 | 33.1 | 29.0 | 13.4 | 24.5 |
| CA-DGAT1-D16 | 18.2 | 32.5 | 31.4 | 12.7 | 23.4 |
| CA-DGAT1-E3 | 18.0 | 30.2 | 28.8 | 13.5 | 27.4 |

TABLE 7-continued

Oil Content and Fatty Acid Composition of Yeast Expressing Novel DGAT Genes from Libraries D, E, and F

| DGAT expressed | FAME (% dry wt) | %16:0 | %16:1 | %18:0 | %18:1 |
|---|---|---|---|---|---|
| CA-DGAT1-D19 | 17.5 | 32.6 | 31.7 | 12.4 | 23.2 |
| CA-DGAT1-D15 | 16.2 | 32.4 | 30.7 | 12.9 | 24.0 |
| CA-DGAT1-D5 | 15.8 | 30.4 | 27.1 | 14.9 | 27.2 |
| CA-DGAT1-E1 | 15.3 | 31.7 | 35.2 | 11.8 | 21.4 |
| CA-DGAT1-F8 | 15.2 | 31.8 | 32.3 | 12.5 | 23.3 |
| CA-DGAT1-E2 | 15.1 | 29.6 | 32.0 | 11.7 | 26.6 |
| CA-DGAT1-D14 | 15.0 | 32.2 | 30.8 | 12.9 | 23.9 |
| CA-DGAT1-E5 | 15.0 | 31.0 | 33.3 | 11.9 | 23.8 |
| CA-DGAT1-D4 | 14.9 | 29.6 | 34.5 | 10.9 | 24.6 |
| CA-DGAT1-F19 | 14.8 | 32.6 | 32.1 | 12.5 | 22.8 |
| CA-DGAT1-D20 | 14.8 | 31.5 | 31.1 | 14.6 | 22.7 |
| CA-DGAT1-E8 | 14.8 | 32.6 | 30.4 | 13.3 | 23.7 |
| CA-DGAT1-D17 | 14.5 | 30.5 | 33.6 | 11.3 | 24.5 |
| CA-DGAT1-E6 | 14.5 | 30.9 | 33.1 | 11.6 | 24.3 |
| CA-DGAT1-D10 | 14.3 | 31.3 | 33.5 | 12.1 | 23.0 |
| CA-DGAT1-D9 | 14.3 | 30.6 | 32.3 | 11.5 | 25.5 |
| CA-DGAT1-F5 | 14.2 | 32.0 | 32.8 | 12.5 | 22.7 |
| CA-DGAT1-E19 | 14.2 | 31.4 | 32.7 | 12.4 | 23.4 |
| CA-DGAT1-E16 | 14.0 | 31.8 | 32.4 | 12.7 | 22.9 |
| CA-DGAT1-E15 | 13.5 | 32.1 | 32.5 | 12.2 | 23.1 |
| CA-DGAT1-F7 | 13.4 | 31.5 | 32.4 | 12.2 | 23.8 |
| CA-DGAT1-F18 | 13.3 | 32.1 | 31.6 | 11.9 | 24.4 |
| CA-DGAT1-F9 | 13.3 | 31.6 | 33.1 | 12.4 | 22.8 |
| CA-DGAT1-F12 | 13.3 | 32.2 | 32.1 | 11.7 | 23.8 |
| CA-DGAT1-E9 | 13.2 | 30.8 | 26.9 | 14.8 | 27.4 |
| CA-DGAT1-D18 | 13.2 | 30.1 | 33.8 | 11.5 | 24.5 |
| CA-DGAT1-D12 | 13.1 | 30.4 | 33.3 | 11.1 | 25.1 |
| CA-DGAT1-D7 | 13.1 | 30.6 | 33.9 | 11.1 | 24.2 |
| CA-DGAT1-D6 | 13.1 | 29.8 | 32.8 | 11.3 | 25.7 |
| CA-DGAT1-D8 | 13.1 | 29.8 | 34.9 | 11.3 | 23.8 |
| CA-DGAT1-E11 | 13.0 | 29.9 | 34.2 | 12.0 | 23.8 |
| CA-DGAT1-E10 | 12.8 | 35.8 | 26.6 | 14.5 | 23.1 |
| CA-DGAT1-F20 | 12.8 | 31.8 | 32.2 | 12.0 | 24.0 |
| CA-DGAT1-F11 | 12.8 | 31.5 | 33.6 | 12.1 | 22.7 |
| CA-DGAT1-F4 | 12.7 | 31.8 | 32.5 | 11.4 | 24.3 |
| CA-DGAT1-E13 | 12.4 | 32.4 | 32.1 | 12.0 | 23.5 |
| CA-DGAT1-F6 | 12.2 | 32.2 | 31.1 | 12.6 | 24.1 |
| CA-DGAT1-F17 | 12.2 | 32.0 | 31.8 | 12.1 | 24.2 |
| CA-DGAT1-E18 | 12.1 | 31.7 | 31.9 | 12.4 | 24.0 |
| CA-DGAT1-E12 | 12.0 | 29.6 | 28.3 | 14.4 | 27.6 |
| CA-DGAT1-F10 | 11.7 | 31.7 | 32.3 | 11.7 | 24.2 |
| CA-DGAT1-F13 | 11.7 | 31.7 | 32.4 | 11.3 | 24.6 |
| CA-DGAT1-F1 | 11.4 | 28.9 | 35.1 | 11.2 | 24.7 |
| CA-DGAT1-F16 | 11.3 | 31.7 | 32.0 | 11.6 | 24.6 |
| CA-DGAT1-D11 | 10.7 | 27.5 | 33.0 | 11.7 | 27.6 |
| CA-DGAT1-D13 | 10.6 | 25.3 | 33.9 | 11.7 | 29.0 |
| CA-DGAT1* control, rep1 | 10.6 | 29.6 | 34.9 | 10.6 | 24.8 |
| CA-DGAT1-F15 | 10.5 | 30.9 | 32.5 | 11.2 | 25.4 |
| CA-DGAT1-F14 | 10.5 | 31.4 | 32.1 | 11.6 | 24.9 |
| CA-DGAT1-F2 | 10.4 | 31.0 | 32.0 | 11.8 | 25.1 |
| CA-DGAT1-E14 | 10.4 | 28.8 | 34.3 | 11.4 | 25.5 |
| CA-DGAT1-E17 | 10.4 | 34.0 | 30.7 | 12.8 | 22.4 |
| CA-DGAT1-F3 | 10.2 | 31.6 | 31.5 | 11.8 | 24.9 |
| CA-DGAT1* control, rep2 | 9.7 | 29.2 | 35.1 | 10.7 | 25.0 |
| CA-DGAT1-D3 | 9.4 | 32.1 | 29.9 | 12.0 | 25.3 |
| CA-DGAT1-D1 | 7.8 | 28.6 | 22.9 | 12.0 | 30.9 |

TABLE 8

Oil Content and Fatty Acid Composition of Yeast Expressing Novel DGAT Genes from Library J

| DGAT expressed | FAME (% dry wt) | FAME (mean of duplicates) | 16:0% | 16:1% | 18:0% | 18:1% |
|---|---|---|---|---|---|---|
| CA-DGAT1-J1 rep1 | 11.9 | | 31.9 | 30.1 | 13.8 | 24.1 |
| CA-DGAT1-J1 rep2 | 11.7 | 11.8 | 31.8 | 30.2 | 13.7 | 24.3 |
| CA-DGAT1-J12 rep 1 | 14.8 | | 35.1 | 31.0 | 14.4 | 19.4 |
| CA-DGAT1-J12 rep 2 | 13.2 | 14.0 | 35.1 | 31.3 | 14.2 | 19.4 |
| CA-DGAT1-J13 rep 1 | 13.2 | | 32.1 | 30.4 | 14.3 | 23.1 |
| CA-DGAT1-J13 rep 2 | 10.6 | 11.9 | 32.5 | 30.3 | 14.3 | 22.9 |
| CA-DGAT1-J16 rep 1 | 12.8 | | 33.6 | 29.4 | 14.4 | 22.6 |
| CA-DGAT1-J16 rep 2 | 11.5 | 12.2 | 33.5 | 29.4 | 14.6 | 22.5 |
| CA-DGAT1-J21 rep 1 | 14.5 | | 33.3 | 30.2 | 13.7 | 22.8 |
| CA-DGAT1-J21 rep 2 | 15.0 | 14.7 | 33.6 | 30.1 | 13.7 | 22.6 |
| CA-DGAT1-J24 rep 1 | 10.8 | | 32.1 | 29.8 | 14.1 | 24.0 |
| CA-DGAT1-J24 rep 2 | 12.4 | 11.6 | 32.6 | 29.9 | 13.9 | 23.6 |
| CA-DGAT1-J32 rep 1 | 9.0 | | 31.4 | 30.1 | 14.4 | 24.0 |
| CA-DGAT1-J32 rep 2 | 8.1 | 8.6 | 31.4 | 30.4 | 14.1 | 24.2 |
| CA-DGAT1-J34 rep 1 | 12.9 | | 33.4 | 29.6 | 14.4 | 22.6 |
| CA-DGAT1-J34 rep 2 | 11.9 | 12.4 | 32.6 | 30.6 | 13.9 | 22.9 |
| CA-DGAT1-J37 rep 1 | 10.8 | | 29.3 | 30.3 | 13.0 | 27.4 |
| CA-DGAT1-J37 rep 2 | 10.0 | 10.4 | 29.5 | 30.3 | 12.8 | 27.4 |
| CA-DGAT1-J38 rep 1 | 11.6 | | 28.9 | 33.6 | 12.4 | 25.1 |
| CA-DGAT1-J38 rep 2 | 10.3 | 11.0 | 28.9 | 33.2 | 12.7 | 25.2 |
| CA-DGAT1* control, rep 1 | 8.3 | | 29.7 | 33.0 | 12.1 | 25.2 |
| CA-DGAT1* control, rep 2 | 7.7 | 8.0 | 29.8 | 32.9 | 12.1 | 25.3 |

Example 5

Novel DGAT Proteins Have Higher Specific Activity than CA-DGAT1*

Yeast microsomal membrane preparations from some high oil yeast strains expressing novel DGAT genes were used for activity assays and western blots to determine DGAT activity per mg microsomal protein, relative DGAT protein abundance, and DGAT activity adjusted for DGAT protein abundance. The activity assays were done as described in Example 2 except that 5 μg microsomal protein and 3 μM C14-labeled 18:1-CoA were used. The endogenous DAG concentration and 3 μM 18:1-CoA appeared to be saturating concentrations for both of these substrates with the CA-DGAT1* enzyme. Western blots were probed with rabbit polyclonal antibodies prepared against the peptide NGNDGGEKIANGEDR (peptide 1, SEQ ID NO: 176), corresponding to amino acid residues 93 to 107 of the CA-DGAT1 amino acid sequence. This antigenic peptide region was identical in all novel DGAT sequences thus far examined (ie. no mutations were present in this region that might affect signal strength on a western blot). Twenty μl of yeast microsomes were mixed with protease inhibitors (1 μl Calbiochem Protease Inhibitor Cocktail Set III, catalog #539134, 1 μl 0.5 M EDTA and 0.5 μl of a 100 mM PMSF stock in isopropanol), and incubated on ice 15 min prior to addition of 2×SDS sample buffer, followed by SDS-PAGE. The Invitrogen I blot dry transfer system was used to transfer protein to nitrocellulose membrane. The membrane was rinsed briefly in TBST (20 mM Tris-HCl pH 7.5, 150 mM NaCl, 0.2% Tween 20), and blocked for 20 min at room temperature in 5% instant nonfat dry milk/TBST with slow rocking. The membrane was then incubated 1 h with a 1:2000 dilution of primary antisera in 3% milk/TBST, washed 3 times for 5 to 10 min in TBST, and then incubated 1 h with a secondary antibody consisting of a 1:5000 dilution of goat anti-rabbit IgG-HRP conjugate (Bio-Rad catalog # 170-6515) in 3% milk/TBST. Following washing in TBST, the membrane was incubated 5 min with the SuperSignal West Dura ECL substrate (Pierce catalog #34075). The blots were imaged using a Fujifilm LAS3000 imaging system. Pixel densities for the target bands were determined with TotalLab's software, Nonlinear TL120 v2006e. For control samples on each blot, several concentrations of microsomal protein from yeast expressing CA-DGAT1* were used. The relative abundance of novel DGAT protein present in microsomes was calculated by comparing with the CA-DGAT1* control microsome samples.

Results of the activity assays and western blots are reported in TABLE 9. As evident in the right column of TABLE 9, 14 of the 19 novel DGATs examined had greater activity than CA-DGAT1* following adjustment for DGAT protein abundance. Three novel DGATs (CA-DGAT1-C9, CA-DGAT1-C11, and CA-DGAT1-E3) had adjusted activities more than 3-fold greater than that of CA-DGAT1*. Such large increases in DGAT specific activity as a result of mutagenesis have not been reported previously. One novel DGAT (CA-DGAT1-J21) had similar adjusted activity, and only 4 (CA-DGAT1-C10, CA-DGAT1-D2, CA-DGAT1-D16, and CA-DGAT1-J16) had lower adjusted activity than CA-DGAT1*. In most cases, the engineered DGAT proteins were less abundant in microsomes than was the CA-DGAT1* protein. Less abundance may be due to either lower expression level in yeast or due to the fact that proportionately more of the novel DGAT protein was in the fat pad, rather than the microsomal pellet, compared with the CA-DGAT1* protein. Some of the yeast strains expressing novel DGATs had extremely large fat pads evident during microsomal preparation, consistent with the very high oil contents reported in TABLES 6, 7, and 8.

TABLE 9

Activity and Relative Abundance of Novel DGAT from High Oil Yeast Strains

| DGAT | DGAT Activity (pmol C14 labeled oleoyl-CoA incorporated into TAG per minute per mg microsomal protein) | DGAT Abundance in Microsomes relative to CA-DGAT1* | DGAT Activity Adjusted for DGAT Abundance (pmol C14 labeled oleoyl-CoA incorporated into TAG per minute per mg microsomal protein) | DGAT Activity Adjusted for DGAT Abundance (% of CA-DGAT1*) |
|---|---|---|---|---|
| CA-DGAT1* | 3596 | 1 | 3596 | 100 |
| A2 | 6184 | 0.92 | 6722 | 187 |
| C9 | 2169 | 0.18 | 12050 | 335 |
| C10 | 2307 | 0.83 | 2780 | 77 |
| C11 | 2362 | 0.2 | 11810 | 328 |
| C13 | 1880 | 0.29 | 6483 | 180 |
| D2 | 2809 | 1.25 | 2247 | 62 |
| D16 | 1891 | 0.95 | 1991 | 55 |
| D19 | 3025 | 0.6 | 5042 | 140 |
| E3 | 2285 | 0.2 | 11425 | 318 |
| J1 | 3128 | 0.73 | 4285 | 119 |
| J12 | 2738 | 0.63 | 4346 | 121 |
| J13 | 3384 | 0.64 | 5288 | 147 |
| J16 | 1753 | 0.55 | 3187 | 89 |
| J21 | 2797 | 0.76 | 3680 | 102 |
| J24 | 2778 | 0.54 | 5144 | 143 |
| J32 | 1266 | 0.25 | 5064 | 141 |
| J34 | 2742 | 0.58 | 4728 | 131 |
| J37 | 1951 | 0.32 | 6097 | 170 |
| J38 | 4142 | 0.79 | 5243 | 146 |

Example 6

Novel DGAT Genes Give Significantly Higher Oil and Oleic Acid Contents in Soybean Somatic Embryos than does CA-DGAT1*

Four novel DGAT genes (CA-DGAT1-A2, CA-DGAT1-C9, CA-DGAT1-C10, and CA-DGAT1-C11) that gave high oil when expressed in yeast, plus the CA-DGAT1* gene, were ectopically expressed in soybean somatic embryos under control of the soybean β-conglycinin α' subunit promoter using the methods of EXAMPLE 3.

Oil content of soybean somatic embryos was determined by NMR using a Maran Ultra NMR analyzer (Resonance Instruments Ltd, Whitney, Oxfordshire, UK). Samples were placed into pre-weighed 2 mL polypropylene tubes (Corning Inc, Corning N.Y., USA; Part no. 430917) previously labeled with unique bar code identifiers. Samples were then placed into 96 place carriers and processed through the following series of steps by an Adept Cobra 600 SCARA robotic system.

1. pick up tube (the robotic arm was fitted with a vacuum pickup devise)
2. read bar code
3. expose tube to antistatic device
4. weigh tube (containing the sample), to 0.0001 g precision.
5. NMR reading; measured as the intensity of the proton spin echo 1 msec after a 22.95 MHz signal had been applied to the sample (data was collected for 32 NMR scans per sample)
6. return tube to rack
7. repeat process with next tube Bar codes, tube weights and NMR readings were recorded by a computer connected to the system. Sample weight was determined by subtracting the polypropylene tube weight from the weight of the tube containing the sample.

Oil content was calculated as follows:

$$\% \text{ oil } (\% \text{ wt basis}) = \frac{(NMR \text{ signal/sample wt (g))} - 70.58)}{351.45}$$

Calibration parameters were determined by precisely weighing samples of soy oil (ranging from 0.0050 to 0.0700 g at approximately 0.0050 g intervals; weighed to a precision of 0.0001 g) into Corning tubes (see above) and subjecting them to NMR analysis. A calibration curve of oil content to NMR value was established.

Results of the oil analysis are presented in TABLE 10 and FIG. 3. Looking at mean values, all 4 novel DGAT genes gave higher oil than did the CA-DGAT1* gene when expressed in soybean somatic embryos. The CA-DGAT1-C11, CA-DGAT1-C10, and CA-DGAT1-C9 values of 9.0, 8.6, and 7.6% oil were considerably greater than the CA-DGAT1* value of 5.5% oil.

TABLE 10

Oil Content of Soybean Somatic Embryos Expressing Novel DGAT Genes or CA-DGAT1*

| | % Oil | | | |
|---|---|---|---|---|
| CA-DGAT1* | CA-DGAT1-A2 | CA-DGAT1-C9 | CA-DGAT1-C10 | CA-DGAT1-C11 |
| 9.3 | 7.7 | 11.5 | 14.2 | 13.3 |
| 9.3 | 7.5 | 10.9 | 13.5 | 13.2 |
| 8.8 | 7.4 | 10.8 | 12.6 | 13.1 |
| 8.1 | 7.4 | 10.6 | 11.5 | 12.7 |
| 7.3 | 7.2 | 10.6 | 10.8 | 12.0 |
| 7.1 | 7.2 | 10.4 | 10.8 | 11.9 |
| 7.0 | 7.1 | 9.6 | 10.7 | 11.2 |
| 6.8 | 7.1 | 9.3 | 10.6 | 11.0 |
| 6.4 | 7.1 | 8.9 | 10.0 | 10.8 |
| 6.3 | 7.1 | 8.5 | 10.0 | 10.8 |

TABLE 10-continued

Oil Content of Soybean Somatic Embryos Expressing Novel DGAT Genes or CA-DGAT1*

| | % Oil | | | | |
|---|---|---|---|---|---|
| | CA-DGAT1* | CA-DGAT1-A2 | CA-DGAT1-C9 | CA-DGAT1-C10 | CA-DGAT1-C11 |
| | 6.3 | 6.5 | 8.1 | 9.8 | 10.2 |
| | 5.6 | 6.4 | 8.1 | 9.7 | 9.9 |
| | 5.5 | 6.3 | 7.9 | 9.5 | 9.3 |
| | 5.4 | 6.2 | 7.7 | 9.3 | 9.3 |
| | 5.4 | 6.1 | 7.7 | 9.3 | 9.2 |
| | 5.1 | 6.1 | 7.6 | 9.0 | 9.2 |
| | 4.9 | 6.1 | 7.4 | 9.0 | 8.7 |
| | 4.7 | 6.1 | 7.2 | 8.9 | 8.4 |
| | 4.6 | 5.8 | 7.0 | 8.7 | 8.4 |
| | 4.6 | 5.8 | 6.7 | 8.2 | 7.9 |
| | 4.5 | 5.7 | 6.2 | 8.1 | 7.9 |
| | 4.1 | 5.7 | 6.1 | 7.9 | 7.2 |
| | 4.1 | 5.3 | 5.9 | 6.8 | 7.1 |
| | 4.1 | 5.2 | 5.5 | 6.3 | 7.0 |
| | 4.1 | 4.9 | 5.5 | 5.9 | 6.9 |
| | 4.0 | 4.5 | 5.3 | 5.7 | 6.8 |
| | 4.0 | 4.4 | 5.1 | 5.4 | 6.4 |
| | 3.9 | 4.1 | 5.1 | 4.6 | 5.8 |
| | 3.7 | 3.5 | 4.9 | 4.0 | 5.5 |
| | 3.5 | 3.5 | 4.8 | 3.9 | 4.3 |
| | 3.4 | 3.3 | 4.5 | 3.1 | 4.2 |
| Mean. | 5.5 | 6.0 | 7.6 | 8.6 | 9.0 |
| Mean of top 10. | 7.6 | 7.3 | 10.1 | 11.5 | 12.0 |

Fatty acid composition of the soy somatic embryos was determined by gas chromatography for the top 4 events of each of the 4 novel DGAT genes and the CA-DGAT1* gene (TABLE 11). Expression of each novel DGAT resulted in more 18:1 and 18:0, and less 18:2 and 16:0, than observed with expression of CA-DGAT1*. Novel DGAT gene expression also resulted in less 18:3 than observed with CA-DGAT1* expression, with the exception of novel DGAT A2.

TABLE 11

Fatty acid composition of soybean somatic embryos expressing CA-DGAT1* or novel DGAT genes.

| DGAT | %16:0 | %18:0 | %18:1 | %18:2 | %18:3 |
|---|---|---|---|---|---|
| CA-DGAT1* | 15.2 | 4.4 | 21.0 | 49.1 | 10.3 |
| CA-DGAT1* | 17.5 | 4.0 | 15.5 | 51.8 | 11.3 |
| CA-DGAT1* | 16.9 | 3.9 | 17.6 | 49.9 | 11.6 |
| CA-DGAT1* | 14.2 | 5.4 | 23.6 | 45.0 | 11.8 |
| Mean of CA-DGAT1* | 16.0 | 4.4 | 19.4 | 48.9 | 11.3 |
| CA-DGAT1-A2 | 15.3 | 4.6 | 22.4 | 46.5 | 11.2 |
| CA-DGAT1-A2 | 14.4 | 5.9 | 25.1 | 42.0 | 12.7 |
| CA-DGAT1-A2 | 14.3 | 6.2 | 23.4 | 43.6 | 12.5 |
| CA-DGAT1-A2 | 15.3 | 6.0 | 27.2 | 40.1 | 11.4 |
| Mean of CA-DGAT1-A2 | 14.8 | 5.7 | 24.5 | 43.0 | 11.9 |
| CA-DGAT1-C9 | 12.9 | 6.8 | 32.2 | 40.0 | 8.1 |
| CA-DGAT1-C9 | 14.5 | 4.6 | 20.9 | 49.9 | 10.0 |
| CA-DGAT1-C9 | 14.1 | 6.0 | 27.7 | 43.3 | 8.9 |
| CA-DGAT1-C9 | 14.0 | 6.3 | 30.5 | 40.0 | 9.1 |
| Mean of CA-DGAT1-C9 | 13.9 | 5.9 | 27.8 | 43.3 | 9.0 |
| CA-DGAT1-C10 | 13.6 | 5.5 | 29.6 | 44.1 | 7.3 |
| CA-DGAT1-C10 | 13.6 | 5.4 | 28.6 | 44.9 | 7.5 |
| CA-DGAT1-C10 | 13.4 | 5.0 | 30.0 | 44.1 | 7.5 |
| CA-DGAT1-C10 | 14.3 | 6.4 | 25.6 | 44.9 | 8.8 |
| Mean of CA-DGAT1-C10 | 13.7 | 5.6 | 28.5 | 44.5 | 7.8 |
| CA-DGAT1-C11 | 14.3 | 4.3 | 23.8 | 48.7 | 8.8 |
| CA-DGAT1-C11 | 13.5 | 4.8 | 29.2 | 43.4 | 9.2 |
| CA-DGAT1-C11 | 13.2 | 5.2 | 29.5 | 43.5 | 8.7 |
| CA-DGAT1-C11 | 14.2 | 4.9 | 26.9 | 45.6 | 8.5 |
| Mean of CA-DGAT1-C11 | 13.8 | 4.8 | 27.4 | 45.3 | 8.8 |

The data of TABLES 10 and 11 demonstrate that novel DGAT genes identified by screening for high oil in yeast give higher oil and oleic acid contents when expressed in soybean somatic embryos than does the CA-DGAT1* gene. Additional novel DGAT genes may be tested by ectopic expression in soybean somatic embryos, and the most promising novel DGAT genes may be expressed in soybean seeds to provide increases in oil and oleic acid content.

Example 7

Sequences of Novel DGAT Genes Giving High Oil Content in Yeast

DNA sequences were determined for 63 of the novel DGAT genes that gave higher oil content in yeast than that obtained with CA-DGAT1*. The corresponding amino acid sequences were deduced from the DNA sequences. The DNA and amino acid sequences of the novel DGATs are presented as SEQ ID NO: 25 to SEQ ID NO: 150. A partial summary of the amino acid substitutions can observed in the alignment of DGAT sequences presented in FIG. 5. The mean number of substitutions observed in the 63 novel DGATs was 10, and the maximum number was 19 (observed in CA-DGAT1-J34). Only 2 of the 63 novel DGATS had less than 4 amino acid substitutions, with CA-DGAT1-F19 having 1, and CA-DGAT1-F8 having 2. Considering all 63 novel DGATs, 115 different substitutions were present at a total of 104 different positions (ie. 2 kinds of substitutions were present at 11 positions). Of the 115 different substitutions, 53 were observed only once, 62 were observed at least twice, 56 were observed at least 3 times, and 50 were observed at least 4 times. The most frequently observed substitution was F514S, which was present in 36 of the 63 novel DGATs.

The 115 different substitutions observed in novel DGAT sequences are: D5G, P7L, G11D, T12A, T18A, H30P, N31A, E34A, T45A, T46A, P48S, P48A, D49S, D49N, G51D, N52D, V54K, V58A, R59T, D66S, S68A, S68P, S73T, S73G, S79N, R80K, E86N, E86D, S87N, N93S, G97D, T109M, A112T, K115Q, Y118L, P123A, A124T, I128V, S135T, F139L, F139S, H143R, L146P, V155I, I162V, K174E, S181A, S181T, R182G, L184S, M191V, P197V, I198V, F199L, F204S, V205M, Q211T, K213R, P218H, L222V, R241K, L247T, T251V, M253V, A256S, C257S, Y266S, T267A, D281E, N288D, N288S, D293E, Y294N, S299T, K301N, M307V, V308L, I324V, S327G, V329L, V329M, Q332R, V334L, I337V, I338V, I346M, E348K, K356Q, K363N, Y368H, A369V, L385F, C390S, L399V, E409G, K412E, H432Y, M435V, V436I, V436R, G451A, A457S, V460A, I475M, C486F, V488I, V491L, R502K, S504T, N508S, F514S, L518V, L531V, N533S, and N533D.

Out of the 115 total substitutions observed, the 62 substitutions that were observed at least twice are: T12A, T18A, H30P, N31A, P48S, D49S, G51D, N52D, R59T, D66S, S68A, S73T, S79N, E86N, S87N, Y118L, P123A, I128V, F139L, V155I, S181A, L184S, P197V, I198V, V205M, Q211T, P218H, L222V, R241K, L247V, T251V, A256S, C257S, Y266F, T267A, D281E, N288D, D293E, Y294N, S299T, K301N, V308L, S327G, V329L, V334L, I337V, I338V, K356Q, K363N, C390S, L399V, V436I, G451A, A457S, I475M, C486F, V488I, V491L, R502K, F514S, L518V, and L531V.

Example 8

Transferring Amino Acid Substitutions from Novel Hazelnut DGAT into Soybean DGAT The novel DGAT genes CA-DGAT1-C9, CA-DGAT1-C10, and CA-DGAT1-C11 were very effective in increasing oil and oleic content in soybean somatic embryos (TABLES 10 and 11). Therefore, some of the amino acid substitutions present in these highly effective novel hazel DGATs were transferred to soybean DGAT to determine whether these same substitutions could increase the effectiveness of soybean DGAT for increasing oil or oleic content. The substitutions that were transferred are summarized in TABLE 12. The soybean DGAT gene with no substitutions is named GM-DGAT1, and the corresponding DNA and deduced amino acid sequences are presented as SEQ ID NO: 152 and 153. The four novel soybean DGAT genes are named GM-DGAT1-C9 (SEQ ID NO: 154 and 155), GM-DGAT1-C10 (SEQ ID NO: 156 and 157), GM-DGAT1-C11 (SEQ ID NO: 158 and 159) and GM-DGAT1-C9C10C11 (SEQ ID NO: 160 and 161). These four novel soybean DGAT proteins contained 5, 5, 11, and 14 amino acid substitutions, respectively.

The NotI fragments containing each synthesized DGAT gene sequence were cloned into the NotI site of soybean expression vector pKR72 (SEQ ID NO:178; described in PCT Publication WO/04071467, published on Aug. 26, 2004) which contains a NotI restriction site, flanked by the promoter for the α' subunit of β-conglycinin (Beachy et al., EMBO J. 4:3047 3053 (1985)) and the 3' transcription termination region of the phaseolin gene (Doyle et al., J. Biol. Chem. 261:9228-9238 (1986)), thus allowing for strong tissue-specific expression in the seeds of soybean of genes cloned into the NotI site. The vector sequences containing wild-type and mutated sequences are summarized in Table 13.

Soybean embryogenic suspension cultures (cv. Jack) were transformed with the vectors described in Table 13, events were selected and somatic embryos were matured as described in Example 3. Experiment numbers for each experiment are also summarized in Table 13.

TABLE 13

Summary of wild-type and mutant GmDGAT1s and respective soybean expression vectors and corresponding experiment names

| Gene | nt SEQ ID NO: | aa SEQ ID NO: | Expression Vector | Vector SEQ ID NO: | Experiment Number |
|---|---|---|---|---|---|
| GM-DGAT1 | 152 | 153 | pKR1466 | 179 | MSE2515 |
| GM-DGAT1-C9 | 154 | 155 | pKR1515 | 180 | MSE2516 |
| GM-DGAT1-C10 | 156 | 157 | pKR1516 | 181 | MSE2517 |
| GM-DGAT1-C11 | 158 | 159 | pKR1517 | 182 | MSE2518 |
| GM-DGAT1-C9C10C11 | 160 | 161 | pKR1520 | 183 | MSE2519 |

TABLE 12

Amino Acid Substitutions in Novel Hazelnut DGAT and the Corresponding Substitutions Made in Soybean DGAT

| Some substitutions observed in novel hazelnut DGAT genes CA-DGAT1-C9, CA-DGAT1-C10, or CA-DGAT1-C11 | Substitutions made in novel soy DGAT GM-DGAT1-C9 | Substitutions made in novel soy DGAT GM-DGAT1-C10 | Substitutions made in novel soy DGAT GM-DGAT1-C11 | Substitutions made in novel soy DGAT GM-DGAT1-C9C10C11 |
|---|---|---|---|---|
| S79N | | | S58N | S58N |
| S181A | S146A | S146A | S146A | S146A |
| V205M | | I170M | | I170M |
| R241K | R206K | | R206K | R206K |
| Y266F | | | Y231F | Y231F |
| D293E | | D258E | | D258E |
| S299T | | | S264T | S264T |
| V308L | V273L | | V273L | V273L |
| I338V | | | I303V | I303V |
| L399V | L364V | | L364V | L364V |
| A457S | | A422S | | A422S |
| I475M | | | I440M | I440M |
| R502K | | | R467K | R467K |
| L518V | L483V | L483V | L483V | L483V |

GM-DGAT1-C9 (SEQ ID NO: 154 and 155), GM-DGAT1-C10 (SEQ ID NO: 156 and 157), GM-DGAT1-C11 (SEQ ID NO: 158 and 159) and GM-DGAT1-C9C10C11 (SEQ ID NO: 160 and 161) were synthesized by GENEART AG (Regensburg, Germany) with NotI restriction enzyme sites flanking the codon-optimized gene sequence (before start codon and after stop codon). In addition, three nucleotides (ACC) were added between the NotI at the 5' end of codon-optimized gene and the ATG start codon in all cases.

Approximately 30 events for each experiment were created in transformations with the vectors described in Table 13. All embryos generated for a given event were harvested in bulk and processed as follows. Embryos were frozen on dry ice or by incubation in a −80° C. freezer for two h followed by lyophilization for 48 h. Dried embryos were ground to a fine powder using a genogrinder vial (½"×2" polycarbonate) and a steel ball (SPEX Centriprep (Metuchen, N.J., U.S.A.). Grinding time was 30 sec at 1450 oscillations per min.

For analysis of fatty acids, a small scoop (~5 mg) of pulverized powder for each event was transferred to a glass GC vial. For transesterification, 50 µL of trimethylsulfonium hydroxide (TMSH) and 0.5 mL of hexane were added to each vial and incubated for 30 min at room temperature while shaking. Fatty acid methyl esters (1 µL injected from hexane layer) were separated and quantified using a Hewlett-Packard 6890 Gas Chromatograph fitted with an Omegawax 320 fused silica capillary column (Catalog #24152, Supelco Inc.). The oven temperature was programmed to hold at 220° C. for 2.6 min, increase to 240° C. at 20° C./min and then hold for an additional 2.4 min. Carrier gas was supplied by a Whatman hydrogen generator. Retention times were compared to those for methyl esters of standards commercially available (Nu-Chek Prep, Inc.).

Oil concentration measurements for each event from each experiment were determined on the remaining dried embryo powders (~20-200 mg each) using NMR as described in Example 6. Oil concentration and fatty acid profile (fatty acid concentration expressed on a wt. % of total fatty acids) results for MSE2515, MSE 2516, MSE2517, MSE2518 and MSE2519 are shown in Tables 14, 15, 16, 17 and 18, respectively. Also shown are the mean oil concentrations (avg.) and mean fatty acid concentrations (expressed as a wt. % of total fatty acids) for all events as well as the mean concentrations for the top five events having highest oil concentrations (Top5 avg.).

TABLE 14

Oil concentrations and fatty acid profiles for events from MSE2515 MSE2515 (GmDGAT1)

| Event | 16:0 | 18:0 | 18:1 | 18:2 | 18:3 | % Oil |
|---|---|---|---|---|---|---|
| 2515-14 | 16.7 | 5.6 | 23.8 | 38.4 | 15.3 | 6.4 |
| 2515-13 | 17.0 | 5.3 | 21.7 | 39.5 | 16.5 | 5.9 |
| 2515-6 | 16.8 | 5.5 | 23.2 | 37.7 | 16.9 | 5.1 |
| 2515-11 | 17.5 | 5.4 | 23.0 | 37.8 | 16.2 | 5.0 |
| 2515-19 | 17.9 | 4.9 | 18.1 | 40.9 | 18.2 | 4.8 |
| 2515-28 | 17.3 | 5.1 | 16.0 | 42.5 | 19.1 | 4.7 |
| 2515-2 | 16.9 | 5.2 | 21.3 | 39.5 | 17.2 | 4.6 |
| 2515-10 | 17.6 | 5.0 | 16.6 | 42.2 | 18.6 | 4.6 |
| 2515-24 | 15.9 | 5.0 | 18.6 | 39.9 | 20.6 | 4.4 |
| 2515-20 | 17.9 | 4.8 | 17.7 | 39.2 | 20.4 | 4.3 |
| 2515-17 | 17.0 | 6.3 | 20.5 | 36.9 | 19.2 | 4.3 |
| 2515-12 | 17.4 | 5.1 | 17.2 | 38.7 | 21.7 | 4.2 |
| 2515-7 | 18.7 | 4.4 | 14.1 | 42.3 | 20.5 | 4.2 |
| 2515-29 | 16.5 | 4.6 | 15.9 | 38.6 | 24.4 | 4.1 |
| 2515-15 | 18.0 | 5.1 | 16.8 | 42.5 | 17.7 | 4.1 |
| 2515-9 | 17.8 | 4.3 | 14.3 | 42.5 | 21.2 | 4.0 |
| 2515-22 | 17.2 | 5.5 | 18.9 | 39.9 | 18.5 | 4.0 |
| 2515-5 | 17.6 | 4.6 | 16.6 | 39.5 | 21.7 | 4.0 |
| 2515-4 | 19.2 | 5.5 | 14.8 | 36.9 | 23.6 | 3.9 |
| 2515-18 | 18.0 | 6.1 | 20.9 | 38.2 | 16.9 | 3.9 |
| 2515-16 | 16.5 | 4.8 | 19.1 | 38.2 | 21.4 | 3.9 |
| 2515-8 | 17.4 | 5.0 | 17.2 | 40.4 | 20.0 | 3.8 |
| 2515-21 | 17.1 | 4.2 | 14.0 | 39.6 | 25.1 | 3.8 |
| 2515-27 | 16.0 | 4.4 | 17.5 | 40.3 | 21.8 | 3.6 |
| 2515-31 | 17.6 | 4.5 | 13.0 | 40.9 | 24.0 | 3.6 |
| 2515-25 | 17.0 | 6.3 | 19.7 | 37.1 | 20.0 | 3.6 |
| 2515-26 | 18.0 | 4.5 | 15.2 | 39.4 | 22.9 | 3.5 |
| 2515-23 | 17.4 | 4.7 | 14.8 | 40.9 | 22.2 | 3.2 |
| 2515-1 | 18.4 | 4.2 | 13.5 | 41.7 | 22.2 | 3.2 |
| 2515-30 | 16.3 | 4.0 | 15.1 | 40.7 | 24.0 | 2.9 |
| 2515-3 | 20.1 | 4.5 | 10.7 | 41.1 | 23.5 | 2.5 |
| Avg. | 17.4 | 5.0 | 17.4 | 39.8 | 20.4 | 4.1 |
| Top5 Avg. | 17.2 | 5.3 | 22.0 | 38.9 | 16.6 | 5.4 |

TABLE 15

Oil concentrations and fatty acid profiles for events from MSE2516 MSE2516 (GmDGAT1-C9)

| Event | 16:0 | 18:0 | 18:1 | 18:2 | 18:3 | % Oil |
|---|---|---|---|---|---|---|
| 2516-8 | 16.3 | 7.1 | 26.4 | 36.5 | 13.7 | 7.1 |
| 2516-28 | 16.9 | 6.9 | 25.2 | 36.8 | 14.3 | 6.7 |
| 2516-4 | 16.0 | 7.0 | 24.5 | 37.1 | 15.3 | 6.6 |
| 2516-16 | 16.0 | 5.4 | 17.8 | 45.9 | 14.8 | 6.2 |
| 2516-19 | 16.4 | 6.0 | 24.8 | 37.6 | 15.1 | 6.1 |
| 2516-25 | 17.2 | 5.4 | 19.3 | 39.4 | 18.7 | 5.7 |
| 2516-27 | 16.1 | 6.5 | 22.3 | 38.6 | 16.4 | 5.7 |
| 2516-6 | 17.6 | 5.3 | 17.2 | 38.7 | 21.1 | 4.8 |
| 2516-1 | 17.2 | 6.3 | 20.7 | 37.9 | 17.9 | 4.8 |
| 2516-30 | 16.3 | 6.2 | 21.0 | 38.9 | 17.7 | 4.7 |
| 2516-13 | 15.6 | 5.6 | 19.5 | 39.4 | 19.9 | 4.5 |
| 2516-22 | 17.1 | 5.2 | 17.8 | 39.9 | 19.9 | 4.3 |
| 2516-26 | 17.1 | 6.0 | 20.2 | 38.1 | 18.6 | 4.3 |
| 2516-12 | 17.7 | 5.7 | 18.8 | 39.1 | 18.8 | 4.3 |
| 2516-5 | 16.9 | 5.3 | 16.2 | 41.7 | 20.0 | 4.2 |
| 2516-15 | 17.6 | 3.8 | 15.2 | 42.1 | 21.3 | 4.1 |
| 2516-29 | 16.2 | 5.1 | 18.8 | 38.6 | 21.2 | 3.9 |
| 2516-9 | 17.3 | 5.8 | 19.9 | 39.0 | 18.1 | 3.8 |
| 2516-23 | 16.8 | 5.6 | 18.9 | 37.3 | 21.3 | 3.8 |
| 2516-3 | 16.6 | 5.3 | 17.4 | 39.8 | 21.0 | 3.7 |
| 2516-21 | 16.6 | 6.0 | 19.5 | 38.0 | 19.9 | 3.6 |
| 2516-10 | 16.3 | 4.5 | 15.5 | 39.9 | 23.8 | 3.6 |
| 2516-2 | 16.5 | 5.4 | 17.3 | 38.0 | 22.9 | 3.5 |
| 2516-11 | 17.7 | 4.9 | 14.2 | 41.6 | 21.6 | 3.5 |
| 2516-18 | 16.5 | 5.5 | 18.6 | 38.9 | 20.6 | 3.5 |
| 2516-7 | 19.0 | 5.0 | 14.7 | 38.8 | 22.5 | 3.4 |
| 2516-24 | 17.9 | 6.2 | 20.7 | 36.6 | 18.6 | 3.2 |
| 2516-17 | 17.0 | 4.2 | 13.4 | 41.2 | 24.2 | 2.9 |
| Avg. | 16.9 | 5.6 | 19.1 | 39.1 | 19.3 | 4.5 |
| Top5 Avg. | 16.3 | 6.5 | 23.8 | 38.8 | 14.6 | 6.5 |

TABLE 16

Oil concentrations and fatty acid profiles for events from MSE2517 MSE2517 (GmDGAT1-C10)

| Event | 16:0 | 18:0 | 18:1 | 18:2 | 18:3 | % Oil |
|---|---|---|---|---|---|---|
| 2517-4 | 15.1 | 5.8 | 28.1 | 40.6 | 10.4 | 10.5 |
| 2517-15 | 15.9 | 5.8 | 26.3 | 39.4 | 12.6 | 9.1 |
| 2517-7 | 16.1 | 5.5 | 25.4 | 40.9 | 12.0 | 9.0 |
| 2517-9 | 18.0 | 5.7 | 23.5 | 41.0 | 11.8 | 8.2 |
| 2517-17 | 15.9 | 7.2 | 30.7 | 34.8 | 11.4 | 7.8 |
| 2517-20 | 17.2 | 5.9 | 22.4 | 40.1 | 14.5 | 7.2 |
| 2517-27 | 18.2 | 4.3 | 17.0 | 43.7 | 16.7 | 6.3 |
| 2517-8 | 16.6 | 6.3 | 25.4 | 37.5 | 14.1 | 6.0 |
| 2517-19 | 16.5 | 4.4 | 17.0 | 44.0 | 18.3 | 5.7 |
| 2517-1 | 16.4 | 5.3 | 17.4 | 42.4 | 18.5 | 5.5 |
| 2517-12 | 17.0 | 5.1 | 18.4 | 42.6 | 17.0 | 5.2 |
| 2517-23 | 16.6 | 5.6 | 23.1 | 38.8 | 15.9 | 4.9 |
| 2517-28 | 17.2 | 5.2 | 23.5 | 36.4 | 17.6 | 4.9 |
| 2517-5 | 16.2 | 5.1 | 18.7 | 40.8 | 19.1 | 4.9 |
| 2517-14 | 18.6 | 6.3 | 22.2 | 36.9 | 15.9 | 4.8 |
| 2517-18 | 17.4 | 6.0 | 20.8 | 39.1 | 16.8 | 4.2 |
| 2517-2 | 18.6 | 4.7 | 13.9 | 42.6 | 20.3 | 4.1 |
| 2517-21 | 16.3 | 4.6 | 20.1 | 40.4 | 18.6 | 4.0 |
| 2517-10 | 16.6 | 6.6 | 26.5 | 33.8 | 16.4 | 3.9 |
| 2517-24 | 18.8 | 5.7 | 19.7 | 38.1 | 17.7 | 3.8 |
| 2517-31 | 16.5 | 4.2 | 19.1 | 39.5 | 20.8 | 3.7 |
| 2517-26 | 18.7 | 4.2 | 12.7 | 40.1 | 24.3 | 3.6 |
| 2517-25 | 18.1 | 5.2 | 17.5 | 40.5 | 18.6 | 3.6 |
| 2517-6 | 17.0 | 4.3 | 16.0 | 40.8 | 21.9 | 3.3 |
| 2517-11 | 17.7 | 4.6 | 15.1 | 40.5 | 22.1 | 3.3 |
| 2517-29 | 17.3 | 4.5 | 15.9 | 40.1 | 22.1 | 3.1 |
| 2517-16 | 17.5 | 3.9 | 11.3 | 42.4 | 24.9 | 3.0 |
| 2517-13 | 17.6 | 5.0 | 18.8 | 37.4 | 21.1 | 2.6 |
| 2517-30 | 18.0 | 4.6 | 15.5 | 39.5 | 22.4 | 2.5 |
| 2517-22 | 17.1 | 4.4 | 14.9 | 39.8 | 23.7 | 2.4 |
| Avg. | 17.2 | 5.2 | 19.9 | 39.8 | 17.9 | 5.0 |
| Top5 Avg. | 16.2 | 6.0 | 26.8 | 39.3 | 11.7 | 8.9 |

TABLE 17

Oil concentrations and fatty acid profiles for events from MSE2518 MSE2518 (GmDGAT1-C11)

| Event | 16:0 | 18:0 | 18:1 | 18:2 | 18:3 | % Oil |
|---|---|---|---|---|---|---|
| 2518-30 | 15.7 | 7.6 | 29.0 | 35.1 | 12.6 | 7.6 |
| 2518-18 | 15.9 | 8.6 | 31.4 | 33.6 | 10.4 | 7.5 |
| 2518-3 | 15.9 | 6.3 | 25.1 | 38.4 | 14.3 | 6.6 |
| 2518-4 | 16.7 | 7.0 | 24.1 | 36.5 | 15.7 | 6.5 |
| 2518-12 | 16.2 | 6.2 | 24.0 | 38.0 | 15.6 | 6.4 |
| 2518-17 | 15.5 | 5.6 | 24.0 | 38.5 | 16.3 | 6.2 |
| 2518-11 | 16.5 | 5.5 | 19.2 | 40.8 | 17.9 | 5.9 |
| 2518-23 | 16.2 | 6.7 | 24.1 | 36.6 | 16.4 | 5.9 |
| 2518-19 | 15.6 | 5.7 | 19.5 | 41.1 | 18.0 | 5.6 |
| 2518-21 | 16.6 | 6.4 | 21.8 | 37.6 | 17.7 | 5.4 |
| 2518-9 | 16.8 | 6.5 | 23.1 | 37.0 | 16.6 | 5.2 |
| 2518-27 | 15.3 | 5.9 | 21.1 | 39.6 | 18.2 | 5.2 |
| 2518-14 | 16.9 | 5.6 | 19.9 | 39.5 | 18.1 | 5.1 |
| 2518-2 | 16.9 | 5.1 | 19.2 | 40.0 | 18.7 | 5.0 |
| 2518-26 | 17.0 | 5.0 | 15.4 | 41.4 | 21.2 | 4.5 |
| 2518-16 | 17.8 | 4.0 | 12.5 | 39.2 | 26.5 | 4.3 |
| 2518-24 | 17.1 | 5.7 | 18.2 | 38.3 | 20.7 | 4.0 |
| 2518-13 | 16.4 | 5.7 | 18.5 | 39.0 | 20.4 | 4.0 |
| 2518-22 | 17.3 | 4.9 | 17.6 | 38.9 | 21.4 | 3.9 |
| 2518-8 | 16.9 | 6.6 | 23.0 | 36.4 | 17.1 | 3.9 |
| 2518-5 | 15.9 | 5.2 | 17.0 | 40.5 | 21.4 | 3.7 |
| 2518-6 | 17.0 | 4.6 | 13.9 | 40.6 | 23.9 | 3.7 |
| 2518-15 | 16.5 | 4.8 | 16.6 | 39.2 | 23.0 | 3.7 |
| 2518-25 | 16.8 | 5.2 | 18.2 | 39.8 | 19.9 | 3.5 |
| 2518-10 | 17.1 | 6.5 | 22.3 | 35.9 | 18.2 | 3.5 |
| 2518-29 | 16.9 | 5.6 | 17.9 | 38.7 | 21.0 | 3.4 |
| 2518-20 | 18.1 | 5.2 | 16.6 | 37.5 | 22.6 | 3.3 |
| Avg. | 16.6 | 5.8 | 20.5 | 38.4 | 18.7 | 4.9 |
| Top5 Avg. | 16.1 | 7.2 | 26.7 | 36.3 | 13.7 | 6.9 |

TABLE 18

Oil concentrations and fatty acid profiles for events from MSE2519 MSE2519 (GmDGAT1-C9C10C11)

| Event | 16:0 | 18:0 | 18:1 | 18:2 | 18:3 | % Oil |
|---|---|---|---|---|---|---|
| 2519-17 | 16.8 | 8.6 | 30.4 | 35.3 | 8.9 | 11.3 |
| 2519-20 | 15.2 | 6.3 | 28.1 | 39.6 | 10.8 | 11.2 |
| 2519-9 | 15.5 | 7.2 | 29.7 | 36.9 | 10.7 | 10.5 |
| 2519-26 | 15.9 | 7.0 | 28.6 | 37.6 | 11.0 | 10.3 |
| 2519-1 | 15.5 | 7.3 | 28.4 | 37.5 | 11.3 | 10.0 |
| 2519-5 | 15.7 | 7.8 | 29.1 | 36.7 | 10.8 | 9.8 |
| 2519-23 | 15.4 | 6.1 | 26.6 | 40.4 | 11.6 | 9.5 |
| 2519-10 | 15.5 | 6.6 | 27.3 | 38.4 | 12.2 | 9.4 |
| 2519-16 | 16.5 | 6.3 | 25.4 | 39.4 | 12.3 | 9.3 |
| 2519-3 | 14.9 | 8.2 | 29.5 | 36.6 | 10.8 | 8.8 |
| 2519-11 | 15.8 | 5.1 | 21.8 | 43.9 | 13.4 | 8.6 |
| 2519-8 | 14.8 | 7.6 | 24.4 | 41.5 | 11.8 | 8.5 |
| 2519-27 | 15.4 | 6.5 | 25.7 | 39.9 | 12.4 | 8.4 |
| 2519-19 | 15.8 | 7.9 | 27.5 | 36.3 | 12.5 | 8.1 |
| 2519-18 | 15.9 | 7.3 | 25.5 | 37.9 | 13.5 | 7.1 |
| 2519-24 | 15.5 | 5.8 | 20.5 | 41.0 | 17.1 | 6.0 |
| 2519-13 | 17.2 | 5.3 | 19.4 | 40.4 | 17.7 | 5.9 |
| 2519-28 | 16.0 | 6.2 | 22.3 | 38.7 | 16.7 | 5.8 |
| 2519-21 | 15.9 | 6.1 | 20.4 | 39.2 | 18.4 | 4.8 |
| 2519-30 | 16.9 | 6.5 | 20.7 | 38.9 | 17.1 | 4.7 |
| 2519-29 | 16.7 | 5.6 | 19.9 | 39.9 | 17.9 | 4.6 |
| 2519-25 | 17.0 | 6.0 | 19.7 | 38.8 | 18.5 | 4.4 |
| 2519-2 | 17.2 | 6.2 | 24.7 | 37.3 | 14.6 | 4.4 |
| 2519-12 | 16.5 | 5.3 | 17.8 | 39.7 | 20.7 | 4.3 |
| 2519-6 | 16.1 | 4.4 | 14.7 | 41.6 | 23.3 | 4.1 |
| 2519-4 | 17.0 | 5.5 | 19.0 | 39.3 | 19.3 | 4.0 |
| 2519-22 | 16.0 | 4.7 | 15.9 | 42.0 | 21.3 | 3.7 |
| 2519-7 | 17.0 | 5.3 | 16.1 | 39.3 | 22.3 | 3.6 |
| 2519-15 | 17.0 | 6.5 | 20.8 | 36.8 | 18.8 | 3.2 |
| 2519-14 | 18.2 | 4.4 | 12.6 | 40.0 | 24.9 | 2.7 |
| Avg. | 16.2 | 6.3 | 23.1 | 39.0 | 15.4 | 6.9 |
| Top5 Avg. | 15.8 | 7.3 | 29.0 | 37.4 | 10.5 | 10.7 |

The average oil concentrations for all events for MSE2515, MSE2516, MSE2517, MSE2518 and MSE2519 are 4.1%, 4.5%, 5.0%, 4.9% and 6.9%, respectively. The average oil concentrations for the top five events having highest oil concentrations for MSE2515, MSE2516, MSE2517, MSE2518 and MSE2519 are 5.4%, 6.5%, 8.9%, 6.9% and 10.7%, respectively.

Oil concentration plotted versus oleic acid concentration for MSE2515, MSE 2516, MSE2517, MSE2518 and MSE2519 is shown in FIG. 6.

Tables 14-18 and FIG. 6, show that GmDGAT1-C9 and GmDGAT1-C11 expression cause a small increase in oil and oleic acid concentrations in somatic embryos over that observed for GmDGAT1. GmDGAT1-C10 had a larger effect and GmDGAT1-C9C10C11 had the largest effect on oil and oleic acid concentrations compared to GmDGAT1 in somatic embryos.

Example 9

Ectopic Expression of Novel DGAT Genes in Soybean Seed

The method for expressing DGAT genes in soybean somatic embryos under control of the soybean β-conglycinin α' subunit promoter was described in EXAMPLE 3. The present example describes the method for expressing DGAT genes in soybean seed, rather than somatic embryos.

Transgenic soybean lines are generated by the method of particle gun bombardment (Klein et al., Nature (London) 327:70-73 (1987); U.S. Pat. No. 4,945,050) using a BIORAD Biolistic PDS1000/He instrument and plasmid DNA as described in EXAMPLE 3. The following stock solutions and media are used for transformation and regeneration of soybean plants:

Stock Solutions:
Sulfate 100× Stock:
  37.0 g $MgSO_4.7H_2O$, 1.69 g $MnSO_4.H_2O$, 0.86 g $ZnSO_4.7H_2O$, 0.0025 g $CuSO_4.5H_2O$
Halides 100× Stock:
  30.0 g $CaCl_2.2H_2O$, 0.083 g KI, 0.0025 g $COCl_2.6H_2O$
P, B, Mo 100× Stock:
  18.5 g $KH_2PO_4$, 0.62 g $H_3BO_3$, 0.025 g $Na_2MoO_4.2H_2O$
Fe EDTA 100× Stock:
  3.724 g $Na_2EDTA$, 2.784 g $FeSO_4.7H_2O$
2,4-D Stock:
  10 mg/mL Vitamin B5 1000× Stock: 10.0 g myo-inositol, 0.10 g nicotinic acid, 0.10 g pyridoxine HCl, 1 g thiamine.
Media (Per Liter):
  SB196: 10 mL of each of the above stock solutions, 1 mL B5 Vitamin stock, 0.463 g $(NH_4)_2 SO_4$, 2.83 g $KNO_3$, 1 mL 2,4-D stock, 1 g asparagine, 10 g Sucrose, pH 5.7
SB103:
  1 pk. Murashige & Skoog salts mixture, 1 mL B5 Vitamin stock, 750 mg $MgCl_2$ hexahydrate, 60 g maltose, 2 g gelrite, pH 5.7.
SB166:
  SB103 supplemented with 5 g per liter activated charcoal.
SB71-4:
  Gamborg's B5 salts, 1 mL B5 vitamin stock, 30 g sucrose, 5 g TC agar, pH 5.7.

To prepare tissue for transformation, soybean embryogenic suspension cultures are maintained in 35 mL liquid medium (SB196) on a rotary shaker (150 rpm) at 28° C. with fluorescent lights providing a 16 h day/8 h night cycle. Cultures are subcultured every two weeks by inoculating approximately 35 mg of tissue into 35 mL of fresh liquid media.

In particle gun bombardment procedures it is possible to use purified 1) entire plasmid DNA; or 2) DNA fragments containing only the recombinant DNA expression cassette(s) of interest. For every seventeen bombardment transformations, 85 L of suspension is prepared containing 1 to 90 picograms (pg) of plasmid DNA per base pair of each DNA plasmid. Recombinant DNA plasmids are precipitated onto gold particles as follows. The DNA in suspension is added to 50 µL of a 20-60 mg/mL 0.6 µm gold particle suspension and then combined with 50 µL $CaCl_2$ (2.5 M) and 20 µL spermidine (0.1 M). The mixture is vortexed for 5 sec, spun in a microfuge for 5 sec, and the supernatant is removed. The DNA-coated particles are then washed once with 150 µL of 100% ethanol, vortexed and spun in a microfuge again, then resuspended in 85 µL of anhydrous ethanol. Five µL of the DNA-coated gold particles are then loaded on each macrocarrier disk.

Approximately 150 to 250 mg of two-week-old suspension culture is placed in an empty 60 mm×15 mm petri plate and the residual liquid removed from the tissue using a pipette. The tissue is placed about 3.5 inches away from the retaining screen and each plate of tissue is bombarded once. Membrane rupture pressure is set at 650 psi and the chamber is evacuated to −28 inches of Hg. Three plates are bombarded, and following bombardment, the tissue from each plate is divided between two flasks, placed back into liquid media, and cultured as described above.

Seven days after bombardment, the liquid medium is exchanged with fresh SB196 medium supplemented with 30-50 mg/L hygromycin. The selective medium is subsequently refreshed weekly or biweekly. Seven weeks post-bombardment, bright green, transformed tissue is observed growing from untransformed, chlorotic or necrotic embryogenic clusters. Isolated green tissue is removed and inoculated into individual wells in six-well culture dishes to generate new, clonally-propagated, transformed embryogenic suspension cultures. Thus, each new line is treated as an independent transformation event in an individual well. These suspensions can then be maintained as suspensions of embryos clustered in an immature developmental stage through subculture or they can be regenerated into whole plants by maturation and germination of individual somatic embryos.

After two weeks in individual cell wells, transformed embryogenic clusters are removed from liquid culture and placed on solidified medium (SB166) containing no hormones or antibiotics for one week. Embryos are cultured at 26° C. with mixed fluorescent and incandescent lights on a 16 h day/8 h night schedule. After one week, the cultures are then transferred to SB103 medium and maintained in the same growth conditions for 3 additional weeks.

Somatic embryos become suitable for germination after four weeks and are then removed from the maturation medium and dried in empty petri dishes for one to five days. The dried embryos are then planted in SB71-4 medium where they are allowed to germinate under the same light and temperature conditions as described above. Germinated embryos are transferred to sterile soil and grown to maturity for seed production. Oil content and fatty acid composition of the seed are determined as described in previous examples.

Example 10

Transferring Amino Acid Substitutions from Novel Hazelnut DGAT into Maize DGAT Increases Specific Activity of Maize DGAT Six amino acid substitutions frequently observed in novel DGAT sequences derived from CA-DGAT1* were transferred to maize DGAT to determine whether these same substitutions could improve the maize enzyme. The maize DGAT gene used for this example is named ZM-DGAT(MOD1) and corresponds to SEQ ID NO: 163. This maize DGAT is identical in amino acid sequence to SEQ ID No: 19 used for sequence homology assessment in Table 2 of EXAMPLE 1. However, the nucleotide sequence of ZM-DGAT(MOD1) was changed to decrease the extremely high GC content in the 5' region of the gene to facilitate cloning. The 6 amino acid substitutions transferred from the novel DGAT genes derived from CA-DGAT1* are L247V, N288D, K356Q, C390S, G451A, and F514S. The corresponding substitutions in maize DGAT are L201V, N242D, K310Q, C344S, G405A, and F468S. Two of the 6 mutations, C344S and F468S, were also made singly and together in maize DGAT. The names, amino acid substitutions and SEQ ID numbers for the novel maize DGATs are ZM-DGAT(MOD2), F468S, SEQ ID NO: 163 and 164; ZM-DGAT(MOD3), C344S, SEQ ID NO: 165 and 166; ZM-DGAT(MOD4), F468S/C344S, SEQ ID NO: 167 and 168, and ZM-DGAT(MOD5), L247V/N288D/K356Q/C390S/G451A/F514S, SEQ ID NO: 169 and 170. The construct named PHP40102 comprising the ZM-DGAT(MOD4) gene in the yeast expression vector is presented as SEQ ID NO: 171 as a representative example. Following expression of the novel maize DGATs in the *Saccharomyces* DGAT/PDAT null, microsomal DGAT activity assays and western blots were done. Microsomal membrane preparations and DGAT activity assays were done as described in EXAMPLE 2. The endogenous DAG concentration and 10 µM 18:1-CoA appeared to be saturating concentrations for both of these substrates with all of these maize enzymes. Western blots were done as described in EXAMPLE 5, except that the rabbit polyclonal antibodies used were prepared against the peptide RLRRAPSADAGDLAGD (peptide 2, SEQ ID NO: 177), corresponding to amino acid positions 27 to 42 of maize DGAT.

Results of the activity assays and western blots are reported in TABLE 20. As evident in the right column of TABLE 19, all of the novel maize DGATs had greater activity than ZM-DGAT(MOD1), following adjustment for DGAT protein abundance. The novel maize DGAT ZM-DGAT(MOD4), which contained two amino acid substitutions, had an adjusted activity that was more than 3-fold greater than that of ZM-DGAT(MOD1). Novel maize DGAT ZM-DGAT(MOD2) had about 2.4 fold greater adjusted activity than ZM-DGAT(MOD1), and the other two novel DGATs had approximately double the adjusted activity of ZM-DGAT(MOD1). Such large increases in DGAT specific activity as a result of mutagenesis as observed here for the novel maize DGATs and in EXAMPLE 5 for the novel hazelnut DGATs have not been previously reported. The novel maize DGATs were less abundant in yeast microsomes than was the ZM-DGAT(MOD1) protein. As mentioned in EXAMPLE 5, less abundance may be due to either lower expression level in yeast or due to the fact that proportionately more of the novel DGAT proteins were in the fat pad, rather than the microsomal pellet, compared with the ZM-DGAT(MOD1) protein. These results show that amino acid substitutions present in novel DGAT genes derived from the hazelnut DGAT gene, and identified by screening for high oil content in yeast, can kinetically improve a type I DGAT from a different plant. Because this transfer of amino acid substitutions was successful going from a dicot DGAT to a monocot DGAT with only 64% amino acid sequence identity (TABLE2), it may be expected that transfer of amino acid substitutions from novel DGATs derived from hazelnut DGAT to more closely related dicot DGATs such as those from the oilseeds soybean (74% identity with hazelnut DGAT, TABLE 2), canola, or sunflower may also be successful.

TABLE 19

Activity and Relative Abundance of Novel Maize DGAT

| DGAT Expressed, Amino Acid Substitutions | DGAT Activity[1] | DGAT Abundance in microsomes relative to ZM-DGAT (MOD1) | DGAT Activity[1] Adjusted for DGAT Abundance | DGAT Activity Adjusted for DGAT Abundance (% of ZM-DGAT (MOD1) |
|---|---|---|---|---|
| ZM-DGAT(MOD1), No substitutions | 1067 ± 13 | 1 | 1067 | 100 |
| ZM-DGAT(MOD2), F468S | 1698 ± 94 | 0.66 | 2573 | 241 |
| ZM-DGAT(MOD3), C344S | 1278 ± 75 | 0.61 | 2095 | 196 |
| ZM-DGAT(MOD4), F468S/C344S | 2507 (only 1 rep done) | 0.61 | 4110 | 385 |
| ZM-DGAT(MOD5), F468S/C344S/L201V/N242D/K310Q/G405A | 1288 ± 36 | 0.62 | 2077 | 195 |

[1]Activity is measured as pmol C14 labeled oleoyl-CoA incorporated into TAG per minute per mg microsomal protein.

Example 11

Construction of Chimeras Comprising Novel DGAT Genes

The type I DGAT polypeptides from higher plant species have high overall amino acid sequence identities, evident in TABLE 2 of EXAMPLE 1. However, sequence identity is much lower in the N-terminal region (approximately ⅓ of the polypeptide), than it is in the remainder of the polypeptide. The DGAT N-terminal variable region from a plant species may improve efficacy when ectopically expressing a foreign DGAT obtained from a different plant species. Chimeric genes were constructed that encode the N-terminal 112 amino acids of maize DGAT fused to the C-terminal 381 amino acids of wild type or novel hazelnut DGAT. The wild type hazelnut DGAT chimera is named ZM-DGAT:CA-DGAT1, and corresponds to SEQ ID NO: 172 and 173. The novel hazelnut DGAT chimera is named ZM-DGAT:CA-DGAT1-C11, and corresponds to SEQ ID NO: 174 and 175. This novel DGAT chimera is presented as a representative example. Similar chimeras may be made with any of the novel DGAT genes disclosed in this invention.

Example 12

Ectopic Expression of Novel DGAT Genes in Maize

Constructs containing an embryo-preferred 16-kD oleosin promoter driving expression of novel DGAT genes are transformed into maize by *Agrobacterium* infection. The constructs also contain a red fluorescent protein DS-RED driven by an aleurone-specific lipid transfer protein 2 (LTP2) promoter to facilitate segregation of transgenic and null kernels for phenotypic analysis. Oil data and fatty acid profiles are obtained from transgenic and null kernels.

For *Agrobacterium*-mediated transformation of maize with novel DGAT cDNAs, the method of Zhao is employed (U.S. Pat. No. 5,981,840, and PCT patent publication WO98/32326; the contents of which are hereby incorporated by reference). Briefly, immature embryos are isolated from maize and the embryos contacted with a suspension of *Agrobacterium*, where the bacteria are capable of transferring the DGAT cDNA, operably linked to a promoter of interest, to at least one cell of at least one of the immature embryos (step 1: the infection step). In this step the immature embryos are immersed in an *Agrobacterium* suspension for the initiation of inoculation. The embryos are co-cultured for a time with the *Agrobacterium* (step 2: the co-cultivation step). The immature embryos are cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). The immature embryos are cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). The immature embryos are cultured on solid medium with a selective agent resulting in the selective growth of transformed cells. The callus is then regenerated into plants (step 5: the regeneration step), and calli grown on selective medium are cultured on solid medium to regenerate the plants.

This transformation method was successfully used previously to increase oil and oleic content in maize by ectopic expression of maize DGAT (Zheng et al. Nature Genetics 40: 367-372). This same method is used here to determine whether even greater increases in maize oil or oleic contents may be achieved through expression of novel DGAT genes disclosed here. Examples of DGAT genes that are tested with this method are SEQ ID NO: 163, 165, 167, 169, 11, 27, 49, 51, 53, 172, and 174. The DGAT genes from dicots may be codon optimized for maize to increase expression level. As a representative example, plasmid PHP36707 (FIG. 4) comprises the novel DGAT CA-DGAT1-C11 in the maize transformation vector.

Example 13

Ectopic Expression of Novel DGAT Genes in a High Oleic Background

Oil from hazelnut has greater than 80% oleic acid (Cristofori et al. J Sci Food Agric 88:1091-1098). Therefore, the DGAT from this species may be especially effective in high oleic tissues containing a high proportion of oleoyl-CoA and di-oleoyl diacylglycerol as substrates during the oil formation period of development. Furthermore, at least some of the novel DGATs that give high oil content in yeast may have improved affinity (lower Km or $S_{0.5}$ values) for oleoyl-CoA and di-oleoyl diacylglycerol, as a result of their numerous amino acid substitutions. It is therefore of interest to express the novel DGAT genes disclosed here in high oleic plants. Ectopic expression of novel DGAT genes in a high oleic background is achieved by crossing transgenic plant lines ectopically expressing these DGATs with lines having reduced FAD2 (delta-12 fatty acid desaturase) expression. Alternatively, cassettes for DGAT expression and cassettes containing FAD2 inhibitory polynucleotide sequences can be simultaneously transformed by the methods of Examples 10 and 11. Examples of FAD2 inhibitory polynucleotide sequences and inhibitory constructs for maize include, but are not limited to, those disclosed in U.S. Patent Application Publication No. 2005-0160494 and WO 2005/063988, herein incorporated by reference in their entirety.

Example 14

Testing Novel Hazelnut DGAT Genes From Library J in Soybean Somatic Embryos and Transferring Library J Amino Acid Substitutions into Soybean DGAT Four novel DGAT genes (CA-DGAT1-J16, CA-DGAT1-J24, CA-DGAT1-J32, and CA-DGAT1-J37) that gave high oil when expressed in yeast, plus the CA-DGAT1* gene, are ectopically expressed in soybean somatic embryos under control of the soybean β-conglycinin α' subunit promoter using the methods of EXAMPLE 3. Oil content and fatty acid profiles of soybean somatic embryos are determined as described herein. It is likely that some or all of the novel DGAT genes from library J will give rise to higher oil and oleic acid concentrations in somatic embryos compared to CA-DGAT1*. Similar results will be observed for these genes when expressed in seed using techniques described herein.

Some or all of the amino acid substitutions present in these novel hazel DGATs from library J will be transferred to soybean DGAT to determine whether these same substitutions can increase the effectiveness of soybean DGAT for increasing oil or oleic content. The substitutions that are transferred are summarized in TABLE 20. The names as well as DNA and deduced amino acid sequences for the five novel soybean DGAT genes are GM-DGAT1-J16 (SEQ ID NO:184 and 185), GM-DGAT1-J24 (SEQ ID NO:186 and 187), GM-DGAT1-J32 (SEQ ID NO:188 and 189), DGAT1-J37 (SEQ ID NO:190 and 191) and GM-DGAT1-J16J24J32J37 (SEQ ID NO:192 and 193). These five novel soybean DGAT proteins contained 11, 11, 11, 9 and 15 amino acid substitutions, respectively. A DNA and deduced amino acid sequence incorporating all of the mutations described in Example 8 from library C and here from library J (GM-DGAT1-JallCall) are set forth in SEQ ID NO:194 and SEQ ID NO:195, respectively.

TABLE 20

Amino Acid Substitutions in Novel Hazelnut DGATs and the Corresponding Substitutions Made in Soybean DGATs

| Hazelnut[1] (J16, J24, J32, or J37) | Soy (J16) | Soy (J24) | Soy (J32) | Soy (J37) | Soy[2] (J16J24J32J37) |
|---|---|---|---|---|---|
| N31A | S24A | S24A | S24A | | S24A |
| S181A | S146A | S146A | | | S146A |
| R241K | R206K | R206K | R206K | R206K | R206K |
| T251V | T216V | T216V | T216V | | T216V |
| Y266F | Y231F | Y231F | | | Y231F |
| S299T | | | S264T | S264T | S264T |
| V308L | V273L | V273L | V273L | V273L | V273L |
| V334L | | | V299L | V299L | V299L |
| I338V | | I303V | | I303V | I303V |
| C390S | C355S | C355S | C355S | C355S | C355S |
| L399V | L364V | L364V | L364V | L364V | L364V |
| V436R | | | | I401R | i401R |
| I475M | I440M | I440M | I440M | | I440M |
| F514S | I479S | | I479S | I479S | I479S |
| L518V | L483V | L483V | L483V | | L483V |

[1]Some substitutions observed in novel hazelnut DGAT genes CA-DGAT1-J16, CA-DGAT1-J24, CA-DGAT1-J32 or CA-DGAT1-J37; SEQ ID NOs: 138, 142, 144, 148, respectively.
[2]SEQ ID NO: 193, incorporates all of the changes from GM-DGAT1-J16, GM-DGAT1-J24, GM-DGAT1-J32, and GM-DGAT1-J37; SEQ ID NOs: 185, 187, 189, and 191, respectively.

Example 15

Analysis of Kernel Oil Content

Nuclear Magnetic Resonance (NMR) Analysis:
Seed are imbibed in distilled water for 12-24 hours at 4° C. The embryo is dissected away and stored in a 48 well plate. The samples are lyophilized over-night in a Virtis 24×48 lyophilizer. The NMR (Process Control Technologies—PCT (Ft. Collins, Colo.) is set up as per the manufacturer's instructions. The NMR is calibrated using a series of 5 mm NMR tubes containing precisely measured amounts of corn oil (Mazola). The calibration standards are 3, 6, 9, 12, 15, 18, 21, 27, 33, and 40 mg of oil.

Example 16

Compositional Analysis of Soybean Seed

The present example describes measurements of seed compositional parameters such as protein content and content of soluble carbohydrates of soybean seed derived from transgenic events that express DGAT genes.

Changes in the composition of soybean seed associated with expression of DGAT genes are measured. To this end the concentrations of protein, soluble carbohydrates and starch are measured as follows.

Non-Structural Carbohydrate and Protein Analysis.
Dry soybean seed are ground to a fine powder in a Geno-Grinder and subsamples are weighed (to an accuracy of 0.1 mg) into 13×100 mm glass tubes; the tubes have Teflon® lined screw-cap closures. Three replicates are prepared for each sample tested. Tissue dry weights are calculated by weighing sub-samples before and after drying in a forced air oven for 18 h at 105 C.

Lipid extraction is performed by adding 2 ml aliquots of heptane to each tube. The tubes are vortex mixed and placed into an ultrasonic bath (VWR Scientific Model 750D) filled with water heated to 6° C. The samples are sonicated at full-power (~360 W) for 15 min and are then centrifuged (5 min×1700 g). The supernatants are transferred to clean 13×100 mm glass tubes and the pellets are extracted 2 more times with heptane (2 ml, second extraction, 1 ml third extraction) with the supernatants from each extraction being pooled. After lipid extraction 1 ml acetone is added to the pellets and after vortex mixing, to fully disperse the material, they are taken to dryness in a Speedvac.

Non-Structural Carbohydrate Extraction and Analysis.

Two ml of 80% ethanol is added to the dried pellets from above. The samples are thoroughly vortex mixed until the plant material is fully dispersed in the solvent prior to sonication at 60 C for 15 min. After centrifugation, 5 min×1700 g, the supernatants are decanted into clean 13×100 mm glass tubes. Two more extractions with 80% ethanol are performed and the supernatants from each are pooled. The extracted pellets are suspended in acetone and dried (as above). An internal standard-phenyl glucopyranoside (100 ul of a 0.5000+/−0.0010 g/100 ml stock) is added to each extract prior to drying in a Speedvac. The extracts are maintained in a desiccator until further analysis.

The acetone dried powders from above are suspended in 0.9 ml MOPS (3-N[Morpholino]propane-sulfonic acid; 50 mM, 5 mM $CaCl_2$, pH 7.0) buffer containing 100 U of heat stable α-amylase (from *Bacillus licheniformis*; Sigma A-4551). Samples are placed in a heat block (90 C) for 75 min and are vortex mixed every 15 min. Samples are then allowed to cool to room temperature and 0.6 ml acetate buffer (285 mM, pH 4.5) containing 5 U amyloglucosidase (Roche 110 202 367 001) is added to each. Samples are incubated for 15-18 h at 55 C in a water bath fitted with a reciprocating shaker; standards of soluble potato starch (Sigma S-2630) are included to ensure that starch digestion goes to completion.

Post-digestion the released carbohydrates are extracted prior to analysis. Absolute ethanol (6 ml) is added to each tube and after vortex mixing the samples are sonicated for 15 min at 60 C. Samples are centrifuged (5 min×1700 g) and the supernatants are decanted into clean 13×100 mm glass tubes. The pellets are extracted 2 more times with 3 ml of 80% ethanol and the resulting supernatants are pooled. Internal standard (100 ul β-phenyl glucopyranoside, as above) is added to each sample prior to drying in a Speedvac.

Sample Preparation and Analysis

The dried samples from the soluble and starch extractions described above are solubilized in anhydrous pyridine (Sigma-Aldrich P57506) containing 30 mg/ml of hydroxylamine HCl (Sigma-Aldrich 159417). Samples are placed on an orbital shaker (300 rpm) overnight and are then heated for 1 hr (75 C) with vigorous vortex mixing applied every 15 min. After cooling to room temperature 1 ml hexamethyldisilazane (Sigma-Aldrich H-4875) and 100 ul trifluoroacetic acid (Sigma-Aldrich T-6508) are added. The samples are vortex mixed and the precipitates are allowed to settle prior to transferring the supernatants to GC sample vials.

Samples are analyzed on an Agilent 6890 gas chromatograph fitted with a DB-17MS capillary column (15m×0.32 mm×0.25 um film). Inlet and detector temperatures are both 275 C. After injection (2 ul, 20:1 split) the initial column temperature (150 C) is increased to 180 C at a rate 3 C/min and then at 25 C/min to a final temperature of 320 C. The final temperature is maintained for 10 min. The carrier gas is $H_2$ at a linear velocity of 51 cm/sec. Detection is by flame ionization. Data analysis is performed using Agilent ChemStation software. Each sugar is quantified relative to the internal standard and detector responses are applied for each individual carbohydrate (calculated from standards run with each set of samples). Final carbohydrate concentrations are expressed on a tissue dry weight basis.

Protein Analysis

Protein contents are estimated by combustion analysis on a Thermo Finnigan Flash 1112EA combustion analyzer. Samples, 4-8 mg, weighed to an accuracy of 0.001 mg on a Mettler-Toledo MX5 micro balance are used for analysis. Protein contents are calculated by multiplying % N, determined by the analyzer, by 6.25. Final protein contents are expressed on a % tissue dry weight basis.

Example 17

Analysis of Lipid Fractions of Transgenic Seed and Somatic Embryos Expressing DGAT Genes Total Lipid Extraction Total lipid is extracted from each event by the method of Bligh, E. G. & Dyer, W. J. (*Can. J. Biochem. Physiol.* 37:911-917 (1959)) with some modifications.

Briefly, approximately 100 mg of ground tissue from each event is added to a 16 mm×125 mm sized test-tube with a teflon-lined screw cap lid. A mixture of methanol:chloroform/2:1 (6 mL) is added and the sample is extracted with gentle mixing for 1 hr after which 2 mL of chloroform is added followed by continued mixing for 30 min. Afterwards, 3.6 mL of water is added, the tube is vortexed vigorously and phases are separated by centrifugation in a clinical centrifuge. The lower organic layer is gently removed to a second glass test tube and the upper aqueous layers are re-extracted with 2 mL of chloroform. Centrifugation is repeated and the lower organic phase is combined with the first organic phase. Samples are dried under a stream of nitrogen at 50 C, total lipid is estimated by weighing and lipid is dissolved in chloroform:methanol/6:1 to a concentration of approximately 10 mg/mL. FAME analysis is carried out on approximately 50 ug of each sample using the sulfuric acid/methanol procedure described herein (Example 4) and results are shown in Table 30.

Separation of Neutral and Polar Lipids

Sep-pak amino-propyl solid phase extraction columns (Waters; 6 cc columns, WAT054560) are equilibrated with 5 mL of methanol followed by 5 mL of methanol:chloroform/1:1 followed by 5 mL of chloroform. Approximately 5 mg of total lipid in chloroform:methanol/6:1 is added to each column, followed by 5×1 mL aliquots of chloroform to elute neutral lipids and all fractions are collected, combined and dried under a stream of nitrogen at 50 C. Polar lipids are then eluted from each column using 5×1 mL aliquots of methanol:chloroform/1:1 followed by 5×1 mL aliquots of methanol and all fractions are combined and dried under nitrogen. Neutral lipids are dissolved in approximately 1 mL of CHCl3:MeOH/6:1 and polar lipids are dissolved in approximately 200 uL of CHCl3:MeOH/6:1. FAME analysis is carried out on approximately 50 ug of neutral lipid using the sulfuric acid/methanol procedure described herein (Example 4).

Separation of TAG, PC and PE by TLC

Approximately 100 uL of neutral lipid extract is loaded 2 cm from the bottom of a Partisil K6 Silica Gel 60 A TLC plate (Whatman, 250 um thickness, 20 cm×20 cm). Similarly, approximately 200 uL of the polar lipid fraction is loaded onto the same TLC plate. Standard solutions (10 mg/mL in chloroform:methanol/6:1) of TAG, PC and PE are also spotted onto the plates. TLC plates are developed in CHCl3:MeOH:AcOH/65:35:8 until solvent front is approximately halfway up the plate. TLC plates are then air dried for 10 min and developed fully in 70:30:1 (v/v/v) hexane:diethylether:acetic acid. Standards are visualized by light staining with iodine vapour and corresponding bands for TAG, PC and PE are cut out of the TLC plate. Silica gel containing each lipid species is derivatized directly with sulfuric acid/methanol as described herein (Example 4) and results are shown in Table 30.

Fatty Acid Positional Analysis of TAG

Fatty acid profiles of the sn2 position of TAG are determined using porcine pancreatic lipase to remove acyl groups from the sn1 and sn3 position of TAG only, followed by transesterification of the resulting monoacylglyceride (MAG) produced. Approximately 5 mg of neutral lipid extract is suspended in 2 mL of 1 M Tris.HCl, pH 8.0 along with 0.2 mL of 2.2% calcium chloride and 0.5 mL of 0.05% Bile salts in a glass screw cap test tube. The lipid is incubated at 37 C. for 5 min, 5 mg of porcine pancreatic lipase is added directly and the suspension is incubated with shaking at 37 C. for 20 min. After incubation, the reaction is terminated with the addition of 1 mL of ethanol followed by 1 mL of 6 M HCl. After mixing, 2.5 mL of diethyl ether is added, phases are separated by centrifugation and the top organic layer is removed carefully. The diethyl ether extraction is repeated and the top diethyl ether phase is combined with the first. After drying over anhydrous sodium sulfate, the diethyl ether is evaporated under a stream of nitrogen at 50 C. and the resulting lipid is dissolved in 200 uL of chloroform:methanol/6:1. The lipid is loaded onto a Partisil K6 TLC plate along with triacylglyceride (TAG), diacylglyceride (DAG), monoacylglyceride (MAG) and free fatty acid (FFA) standards and the TLC plate is developed as described herein. Afterwards, standards are visualized with light iodine staining and the MAG band is cut and derivatized with methanol/sulfuric acid as previously described herein. The % of total fatty acid for each fatty acid (i.e. 16:0, 18:0, 18:1, 18:2, 18:3) at the sn1 and sn3 positions of TAG is calculated with the following formula: $=([TAGx]-[sn2x]/3)*3/2$; where the x indicates the fatty acid of interest.

SEQUENCE LISTING (222 sequences)

SEQ ID NO: 1 - DNA, 21 bp, Artificial Sequence
  primer P21
caaggagagtccgcttagctc

SEQ ID NO: 2 - DNA, 26 bp, Artificial Sequence
  primer P18
cagaaaatgaaccagaagatcatgtt

SEQ ID NO: 3 - DNA, 32 bp, Artificial Sequence
  primer P33
ttttggatccatggcgatttcggatatgcctg

SEQ ID NO: 4 - DNA, 35 bp, Artificial Sequence
  primer P34
ttttcccgggttattcagtctgcccttttcggttc

SEQ ID NO: 5 - DNA, 40 bp, Artificial Sequence
  primer P37b
ttttagatctatggcgatttcggatatgcctgaaagcacg

SEQ ID NO: 6 - DNA, 38 bp, Artificial Sequence
  primer P38
ttttcccgggttattcagtcttccctttacggttcatc

SEQ ID NO: 7 - DNA, 1617 bp, Carya ovata
atggcgatttcggatatgcctgaaagcacggacaccacagccgctaccaccaccactctccctcacaccggctctgatcttcggaaacggcctgccgccgccgttaccagacaagtctccgattgtacttccaagatgaaggattccgagtccgatgactcggctagagaatccgtcacatactccggcagcgaagattcgttattagggaagagctgcgaggacgacaggaatcacactggagctgcaattgagtcggaaaatcgtaagactactgtaaacgacggaggtgagaagattgcgaacagtcaggatcggggaacggatttcaatgcggcgaaactctcgtatcggccatctgctcctgctcataggagaataaaggagagccctcttagctccgacttaatcttcagacagagtcacgcggggctctttaatctctgtatagtagtgcttgttgctgtaaacagccgactaatcattgagaatcttatgaagtacggttggttaattaggactggcttttggtttagttcgagatcattgagagattggccccttcttatgtgttgtcttaccctcccgatattcccacttgctgcctttatagtggaaagattagtgcaaaagaagtatatctctgaacctgttgtcattttactgcatgtaatcattaccacagcttcagtttgttacccagtttttgttatactgaggtgtgactcggctgttttatttggcgttgtgttgatgctctttgcttgcattgtatggctaaaattggtatcttatgcgcacacaaactatgatatgagagcacttaccaaatcaattgaaaaggaggatgtcctgcccagttctctgaatccagattatcctcacagtgttagctttaagagtttaacttacttcatggttgccccaaccttatgttaccagccatgctatcctcgtacgccagccattcgaaagggttgggtggttcgtcaacttttgaagttgataatttttacaggagtcatgggattcataatagaacaatatataaatcctattgtcaagaattcacagcatcccttgaaagggaaccttttatatgccatagagagggttttgaagctgtcagtgccaaatttatacgtgtggctttgcatgttttactgcttctttcacctctggttaaatatactggctgaacttcttcgatttggtgatcgtgagttttacaaagattggtggaatgctaaaacagttgaagagtattggagaatgtggaatatgcctgttcataaatggatggttcgccatatatattttccatgcatacggaatgggatatcgaagggagtggccagtctaatcgccttccttgtgtctgctgtattccatgagttgtgcattgctgttccatgccatatgttcaagctgtgggcttttattggcattatgtttcaggtacccttggttatgatcacaaattacctgcaaaacaagttcagaaactccatggtgggaaatatgatcttctggttcattttctgtattctgggtcaacccatgtgtgtgcttctatactaccacgacttgatgaaccgaaaagggcagactgaataa

SEQ ID NO: 8 - protein, 538 aa, Carya ovata
MAISDMPESTDTTAATTTTLPHTGSDLRKRPAAAVTRQVSDCTSKMKDSESDDSARESVTYSGSEDSLLGKSCEDDRNHTGAAIESENRKTTVNDGGEKIANSQDRGTDFNAAKLSYRPSAPAHRRIKESPLSSDLIFRQSHAGLFNLCIVVLVAVNSRLIIENLMKYGWLIRTGFWFSSRSLRDWPLLMCCLTLPIFPLAAFIVERLVQKKYISEPVVILLHVIITTASVCYPVFVILRCDSAVLFGVVLMLFACIVWLKLVSYAHTNYDMRALTKSIEKEDVLPSSLNPDYPHSVSFKSLTYFMVAPTLCYQPCYPRTPAIRKGWVVRQLLKLIIFTGVMGFIIEQYINPIVKNSQHPLKGNLLYAIERVLKLSVPNLYVWLCMFYCFFHLWLNILAELLRFGDREFYKDWWNAKTVEEYWRMWNMPVHKWMVRHIYFPCIRNGISKGVASLIAFLVSAVFHELCIAVPCHMFKLWAFIGIMFQVPLVMITNYLQNKFRNSMVGNMIFWFIFCILGQPMCVLLYYHDLMNRKGQTE

SEQ ID NO: 9 - DNA, 1617 bp, Carya ovata
atggcgatttcggatatgcctgaaagcacggacaccacagccgctaccaccaccactctccctcacaccggctctgatcttcggaaacggcctgccgccgccgttaccagacaagtctccgattgtacttccaagatgagggattccgagtccgatgactcggctagagaatccgtcacatactccgacagcgaagattcgttattagggaagagctgcgaggacgacaggaatcacactggagctgcaattgagtcggaaaatcgtaagactactgtaaacgacggaggtgagaagattgcgaacagtcaggatcggggaacggatttcaatgcggcgaaactctcgtatcggccatctgctcctgctcataggagaataaaggagagccctcttagctccgacttaatcttcagacagagtcacgcggggctctttaatctctgtatagtagtgcttgttgctgtaaacagccgactaatcattgagaatcttatgaagtacggttggttaattaggactggcttttggtttagttcgagatcattgagagattggccccttcttatgtgttgtcttaccctcccgatattcccacttgctgcctttatagtggaaagattagtgcaaaagaagtatatctctgaacctgttgtcgttttactgcatgtaatcattaccacagcttcagtttgttacccagtttttgttatactgaggtgtgactcggctgttttatttggcgttgtgttgatgctctttgcttgcattgtatggctaaaattggtatcttatgcgcacacaaactatgatatgagagcacttaccaaatcaattgaaaaggaggatgtcctgcccagttctctgaatccagattatcctcacagtgttagctttaagagtttaacttacttcatggttgccccaaccttatgttaccagccatgctatcctcgtacgccagccattcgaaagggttgggtggttcgtcaacttttgaagttgataatttttacaggagtcatgggattcataatagaacaatatataaatcctattgtcaagaattcacagcatcccttgaaagggaaccttttatatgccatagagagggttttgaagctgtcagtgccaaatttatacgtgtggctttgcatgttttactgcttctttcacctctggttaaatatactggctgaacttcttcgatttggtgatcgtgagttttacaaagattggtggaatgctaaaacagttgaagagtattggagaatgtggaatatgcctgttcataaatggatggttcgccatatatattttccatgcatacggaatgggatatcgaagggagtggccagtctaatcgccttccttgtgtctgctgtattccatgagttgtgcattgctgttccatgccatatgttcaagctgtgggcttttattggcattatgtttcaggtacccttggttatgatcacaaattacctgcaaaacaagttcagaaactccatggtgggaaatatgatcttctggttcattttctgtattctgggtcaacccatgtgtgtgcttctatactaccacgacttgatgaaccgaaaagggcagactgaataa

SEQ ID NO: 10 - protein, 538 aa, Carya ovata
MAISDMPESTDTTAATTTTLPHTGSDLRKRPAAAVTRQVSDCTSKMRDSESDDSARESVTYSDSEDSLLGKSCEDDRNHTGAAIESENRKTTVNDGGEKIANSQDRGTDFNAAKLSYRPSAPAHRRIKESPLSSDLIFRQSHAGLFNLCIVVLVAVNSRLIIENLMKYGWLIRTGFWFSSRSLRDWPLLMCCLTLPIFPLAAFIVERLVQKKYISEPVVVLLHVIITTASVCYPVFVILRCDSAVLFGVVLMLFACIVWLKLVSYAHTNYDMRALTKSIEKEDVLPSSLNPDYPHSVSFKSLTYFMVAPTLCYQPCYPRTPAIRKGWVVRQLLKLIIFTGVMGFIIEQYINPIVKNSQHPLKGNLLYAIERVLKLSVPNLYVWLCMFYCFFHLWLNILAELLRFGDREFYKDWWNAKTVEEYWRMWNMPVHKWMVRHIYFPCIRNGISKGVASLIAFLVSAVFHELCIAVPCHMFKLWAFIGIMFQVPLVMITNYLQNKFRNSMVGNMIFWFIFCILGQPMCVLLYYHDLMNRKGQTE

SEQ ID NO: 11 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgacggatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaattcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 12 - protein, 539 aa, Corylus americana
MAISDMPESTGTTATTATMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFFFCILGQPMCVLLYYHDLMNRKGKTE

SEQ ID NO: 13 - DNA, 9074 bp, Artificial Sequence
  plasmid PHP32238
gacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctcttgtgcagttagacgcgaatttttcgaagaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaactagtggatccatggcgatttcggatatgcctgaaagcacggacaccacagccgctaccaccaccactctccctcacaccggctctgatcttcggaaacggcctgccgccgccgttaccagacaagtctccgattgtacttccaagatgaaggattccgagtccgatgactcggctagagaatccgtcacatactccggcagcgaagattcgttattagggaagagctgcgaggacgacaggaatcacactggagctgcaattgagtcggaaaatcgtaagactactgtaaacgacggaggtgagaagattgcgaacagtcaggatcggggaacggatttcaatgcggcgaaactctcgtatcggccatctgctcctgctcataggagaataaaggagagccctcttagctccgacttaatcttcagacagagtcacgcggggctctttaatctctgtatagtagtgcttgttgctgtaaacagccgactaatcattgagaatcttatgaagtacggttggttaattaggactggcttttggtttagttcgagatcattgagagattggccccttcttatgtgttgtcttaccctcccgatattcccacttgctgcctttatagtggaaagattagtgcaaaagaagtatatctctgaacctgttgtcattttactgcatgtaatcattaccacagcttcagtttgttacccagtttttgttatactgaggtgtgactcggctgttttatttggcgttgtgttgatgctctttgcttgcattgtatggctaaaattggtatcttatgcgcacacaaactatgatatgagagcacttaccaaatcaattgaaaaggaggatgtcctgcccagttctctgaatccagattatcctcacagtgttagctttaagagtttaacttacttcatggttgccccaaccttatgttaccagccatgctatcctcgtacgccagccattcgaaagggttgggtggttcgtcaacttttgaagttgataatttttacaggagtcatgggattcataatagaacaatatataaatcctattgtcaagaattcacagcatcccttgaaagggaaccttttatatgccatagagagggttttgaagctgtcagtgccaaatttatacgtgtggctttgcatgttttactgcttctttcacctctggttaaatatactggctgaacttcttcgatttggtgatcgtgagttttacaaagattggtggaatgctaaaacagttgaagagtattggagaatgtggaatatgcctgttcataaatggatggttcgccatatatattttccatgcatacggaatgggatatcgaagggagtggccagtctaatcgccttccttgtgtctgctgtattccatgagttgtgcattgctgttccatgccatatgttcaagctgtgggcttttattggcattatgtttcaggtacccttggttatgatcacaaattacctgcaaaacaagttcagaaactccatggtgggaaatatgatcttctggttcattttctgtattctgggtcaacccatgtgtgtgcttctatactaccacgacttgatgaaccgaaaagggcagactgaataacccgggctgcaggaattcgatatcaagcttatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcggttttaattttgtttcttcttcttcttcttcttcaattaacaatgtgccttcatcatttttcatttctttcagttcttctaattctcttggagacaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 14 - DNA, 9074 bp, Artificial Sequence
  plasmid PHP32396
gacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctcttgtgcagttagacgcgaatttttcgaagaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaactagtggatccatggcgatttcggatatgcctgaaagcacggacaccacagccgctaccaccaccactctccctcacaccggctctgatcttcggaaacggcctgccgccgccgttaccagacaagtctccgattgtacttccaagatgagggattccgagtccgatgactcggctagagaatccgtcacatactccgacagcgaagattcgttattagggaagagctgcgaggacgacaggaatcacactggagctgcaattgagtcggaaaatcgtaagactactgtaaacgacggaggtgagaagattgcgaacagtcaggatcggggaacggatttcaatgcggcgaaactctcgtatcggccatctgctcctgctcataggagaataaaggagagccctcttagctccgacttaatcttcagacagagtcacgcggggctctttaatctctgtatagtagtgcttgttgctgtaaacagccgactaatcattgagaatcttatgaagtacggttggttaattaggactggcttttggtttagttcgagatcattgagagattggccccttcttatgtgttgtcttaccctcccgatattcccacttgctgcctttatagtggaaagattagtgcaaaagaagtatatctctgaacctgttgtcgttttactgcatgtaatcattaccacagcttcagtttgttacccagtttttgttatactgaggtgtgactcggctgttttatttggcgttgtgttgatgctctttgcttgcattgtatggctaaaattggtatcttatgcgcacacaaactatgatatgagagcacttaccaaatcaattgaaaaggaggatgtcctgcccagttctctgaatccagattatcctcacagtgttagctttaagagtttaacttacttcatggttgccccaaccttatgttaccagccatgctatcctcgtacgccagccattcgaaagggttgggtggttcgtcaacttttgaagttgataatttttacaggagtcatgggattcataatagaacaatatataaatcctattgtcaagaattcacagcatcccttgaaagggaaccttttatatgccatagagagggttttgaagctgtcagtgccaaatttatacgtgtggctttgcatgttttactgcttctttcacctctggttaaatatactggctgaacttcttcgatttggtgatcgtgagttttacaaagattggtggaatgctaaaacagttgaagagtattggagaatgtggaatatgcctgttcataaatggatggttcgccatatatattttccatgcatacggaatgggatatcgaagggagtggccagtctaatcgccttccttgtgtctgctgtattccatgagttgtgcattgctgttccatgccatatgttcaagctgtgggcttttattggcattatgtttcaggtacccttggttatgatcacaaattacctgcaaaacaagttcagaaactccatggtgggaaatatgatcttctggttcattttctgtattctgggtcaacccatgtgtgtgcttctatactaccacgacttgatgaaccgaaaagggcagactgaataacccgggctgcaggaattcgatatcaagcttatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcggttttaattttgtttcttcttcttcttcttcttcaattaacaatgtgccttcatcatttttcatttctttcagttcttctaattctcttggagacaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 15 - DNA, 9077 bp, Artificial Sequence
  plasmid PHP32395
gacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctcttgtgcagttagacgcgaatttttcgaagaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaactagtggatctatggcgatttcggatatgcctgaaagcacgggcaccaccgccaccaccgccaccatgcctcacggcggttcggatcttcgaagacgacataacgccaccgaaaccacggaagtgtctgattcaaattctaaaacgacggatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaattcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataacccgggctgcaggaattcgatatcaagcttatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcggttttaattttgtttcttcttcttcttcttcttcaattaacaatgtgccttcatcatttttcatttctttcagttcttctaattctcttggagacaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 16 - protein, 504 aa, Glycine max
MAISDEPESVATALNHSSLRRRPSATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQRKCIPEPVVVVLHIIITSTSLFYPVLVILRCDSAFVSGVTLMLFSCVVWLKLVSYAHTNYDMRALTKLVEKGEALLDTLNMDYPYNVSFKSLAYFLVAPTLCYQPSYPRTPYIRKGWLFRQLVKLIIFTGVMGFIIDQYINPIVQNSQHPLKGNLLYATERVLKLSVPNLYVWLCMFYCFFHLWLNILAELLRFGDREFYKDWWNAKTVEDYWRMWNMPVHKWMIRHLYFPCLRHGLPKAAALLIAFLVSALFHELCIAVPCHIFKLWAFGGIMFQVPLVLITNYLQNKFRNSMVGNMIFWFIFSILGQPMCVLLYYHDLMNRKGKLD

SEQ ID NO: 17 - protein, 520 aa, Arabidopsis thaliana
MAILDSAGVTTVTENGGGEFVDLDRLRRRKSRSDSSNGLLLSGSDNNSPSDDVGAPADVRDRIDSVVNDDAQGTANLAGDNNGGGDNNGGGRGGGEGRGNADATFTYRPSVPAHRRARESPLSSDAIFKQSHAGLFNLCVVVLIAVNSRLIIENLMKYGWLIRTDFWFSSRSLRDWPLFMCCISLSIFPLAAFTVEKLVLQKYISEPVVIFLHIIITMTEVLYPVYVTLRCDSAFLSGVTLMLLTCIVWLKLVSYAHTSYDIRSLANAADKANPEVSYYVSLKSLAYFMVAPTLCYQPSYPRSACIRKGWVARQFAKLVIFTGFMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHIYFPCLRSKIPKTLAIIIAFLVSAVFHELCIAVPCRLFKLWAFLGIMFQVPLVFITNYLQERFGSTVGNMIFWFIFCIFGQPMCVLLYYHDLMNRKGSMS

SEQ ID NO: 18 - protein, 508 aa, Triticum aestivum
MSKGNPDPHLPGSFLPSHGGPPPKPKTPPRTFRNLPSSSTHGPAPSVAAATIATTPPSASAAPLPPTVHGEAAHGAAAAARRDALLPGVGAAHRRVKESPLSSDAIFRQSHAGLLNLCIVVLIAVNSRLIIENLMKYGLLIRAGFWFSARSLGDWPLLMCCLTLPIFPLAALMTEKWAQRKLIRDHVSILLHIIITTTVLIYPVVVILKCESAVLSGFVLMFIASITWLKLVSFAHTNYDIRILSQSIEKGATHGSSIDEENIKGPTINSVVYFMLAPTLCYQPSYPRTAFIRKGWVTRQLIKCVVFTGLMGFIIEQYINPIVQNSKHPLNGNFLDAIERVLKLSVPTLYVWLCMFYSFFHLWLNILAELLRFGDREFYKDWWNAKTVEEYWRMWNMPVHKWIVRHIYFPCIRNGLSKGCAILIAFLVSAVFHELCIAVPCHIFKLWAFSGIMFQIPLLFLTKYLQDKFKNTMVGNMIFWFFFSIVGQPMCVLLYYHDVMNRQAQTNG

SEQ ID NO: 19 - protein, 494 aa, Zea mays
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYCFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFFFSIVGQPMCVLLYYHDVMNRQAQASR

SEQ ID NO: 20 - DNA, 11696 bp, Artificial Sequence
  plasmid pKS394
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccctagtggatctatggcgatttcggatatgcctgaaagcacgggcaccaccgccaccaccgccaccatgcctcacggcggttcggatcttcgaagacgacataacgccaccgaaaccacggaagtgtctgattcaaattctaaaacgacggatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaattcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataaccc

SEQ ID NO: 21 - DNA, 10866 bp, Artificial Sequence
  Plasmid pKS352
  misc_feature (9689)..(9689): n is a, c, g, or t
agcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccaactaaaaaaagctctcaaattacattttgagttgtttcaggttccattgccttattgctaaaactccaactaaaataacaaatagcacatgcaggtgcaaacaacacgttactctgatgaaggtgatgtgcctctagcagtctagcttatgaggctcgctgcttatcaacgattcatcattccccaagacgtgtacgcagattaaacaatggacaaaacttcaatcgattatagaataataattttaacagtgccgacttttttctgtaaacaaaaggccagaatcatatcgcacatcatcttgaatgcagtgtcgagtttggaccatttgagtacaaagccaatattgaatgatttttcgattttacatgtgtgaatcagacaaaagtgcatgcaatcacttgcaagtaaattaaggatactaatctattcctttcattttatatgctccacttttatataaaaaaatatacattattatatatgcattattaattattgcagtattatgctattggttttatggccctgctaaataacctaaatgagtctaactattgcatatgaatcaaatgaaggaagaatcatgatctaaacctgagtacccaatgcaataaaatgcgtcctattacctaaacttcaaacacacattgccatcggacgtataaattaatgcatatagattattttgagaaaagaaaacatcaaaagctctaaaacttcttttaactttgaaataagctgataaaaatacgctttaaatcaactgtgtgctgtatataagctgcaatttcacattttaccaaaccgaaacaagaatggtaacagtgaggcaaaaatttgaaaaatgtcctacttcacattcacatcaaattaattacaactaaataaataaacatcgtgattcaagcagtaatgaaagtcgaaatcagatagaatatacacgtttaacatcaattgaatttttttttaaatggatatatacaagtttactattttatatataatgaaaattcattttgtgttagcacaaaacttacagaaagagataaattttaaataaagagaattatatccaattttataatccaaaataatcaaattaaagaatattggctagatagaccggctttttcactgcccctgctggataatgaaaattcatatcaaaacaatacagaagttctagtttaataataaaaaagttggcaaactgtcattccctgttggtttttaagccaaatcacaattcaattacgtatcagaaattaatttaaaccaaatatatagctacgagggaacttcttcagtcattactagctagctcactaatcactatatatacgacatgctacaagtgaagtgaccatatcttaatttcaaatcataaaattcttccaccaagttgcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccaagctgatccactagttctagagcggcccgcgccgtcgacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccggccgctacaggaacaggtggtggcggccctcggcgcgctcgtactgctccacgatggtgtagtcctcgttgtgggaggtgatgtccagcttggagtccacgtagtagtagccgggcagctgcacgggcttcttggccatgtagatggacttgaactccaccaggtagtggccgccgtccttcagcttcagggccttgtggatctcgcccttcagcacgccgtcgcgggggtacaggcgctcggtggaggcctcccagcccatagtcttcttctgcattacggggccgtcggaggggaagttcacgccgatgaacttcaccttgtagatgaaggagccgtcctgcagggaggagtcctgggtcacggtcaccacgccgccgtcctcgaagttcatcacgcgctcccacttgaagccctcggggaaggacagcttcttgtagtcggggatgtcggcggggtgcttcacgtacaccttggagccgtactggaactggggggacaggatgtcccaggcgaagggcagggggccgcccttggtcaccttcagcttggcggtctgggtgccctcgtaggggcggccctcgccctcgccctcgatctcgaactcgtggccgttcacggagccctccatgcgcaccttgaagcgcatgaactccttgatgacgtcctcggaggaggccatgggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaagtgtgttattaacccttctcttcgaggatc

SEQ ID NO: 22 - DNA, 7457 bp, Artificial Sequence
  plasmid pSZ378
gacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctcttgtgcagttagacgcgaatttttcgaagaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaactagtggatcccccgggctgcaggaattcgatatcaagcttatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcggttttaattttgtttcttcttcttcttcttcttcaattaacaatgtgccttcatcatttttcatttctttcagttcttctaattctcttggagacaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 23 - DNA, 1620 bp, Artificial Sequence
  plasmid CA-DGAT1*
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 24 - DNA, 9065 bp, Artificial Sequence
  plasmid pKR52
gacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctcttgtgcagttagacgcgaatttttcgaagaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaactagtggatccatggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataagaattcgatatcaagcttatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcggttttaattttgtttcttcttcttcttcttcttcaattaacaatgtgccttcatcatttttcatttctttcagttcttctaattctcttggagacaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 25 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaattcggtgagagaatctgtcagagtcagagattcgagcaccgacgagtccctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaaatgcgattctgtagttgtttcaggtgtcaccttgatgctatttgcttgcattgtatggttaaaattggtgtcttatacgcatacaaactatgatatgagagcgctggcaaaatcgattgaaaagggggatgtcctgcccgactctctgaataccgattatccttacagtgttacattcaagagtttggcttacttcatggttgctccaaccttatgttaccagacaagctatcctcgtacggcatgcattcgaaagagttgggtggttcgtcaactattgaagttggtcgtctttacaggagttatgggattcataatagaacaatatattaatcctattgtccaaaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatgttcaagttgtgggcttttattggaattatgtgtcaggttcccttggttctgattaccaattacctgcaaaataagttcaagaactctatggtgggaaacatgatcttctggttctttttctgtattgtaggtcaacccatgtgtgtgcttctatactaccatgacttgatgaaccgtaaagggaagactgaataa

SEQ ID NO: 26 - protein, 539 aa, Corylus americana
MAISDMPESTGTTATTATMPHGGSDLRRRHNATETTEVSDSNSKTTDPDSGNSVRESVRVRDSSTDESLARKSCEDDGNRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPIFPAAAFVVEKLVQWKYISEPVVLLLHFIITTAALLYPVFVILKCDSVVVSGVTLMLFACIVWLKLVSYTHTNYDMRALAKSIEKGDVLPDSLNTDYPYSVTFKSLAYFMVAPTLCYQTSYPRTACIRKSWVVRQLLKLVVFTGVMGFIIEQYINPIVQNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILISFFVSAIFHELCIAVPCHMFKLWAFIGIMCQVPLVLITNYLQNKFKNSMVGNMIFWFFFCIVGQPMCVLLYYHDLMNRKGKTE

SEQ ID NO: 27 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaattcggttagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccggtctttccagctgctgccttcatggtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttttacgcatacaaactatgatatgagagcgctggcaaaatcgattgataagggggatgtcctgcccgactctctgaataccgattatccttacagtgttagcttcaagagtttggcttacttcatggttgctccaaccttatgttaccagacaagctatcctcgtacggcatgcattcgaaagagttgggtggttcgtcaactagtgaagttgatcgtctttacaggagttatgggattcataatagaacaatatattaatcctattgtccaaaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatattcaagttgtgggcttttattggaattatgtgtcaggttcccttggttctgattaccaattacctgcaaaataagttcaagaactctatggtgggaaacatgatcttctggttctttttctgtattcttggtcaacccatgtgtgtgcttctatactaccatgacgtcatgaaccgtaaagggaagactgaataa

SEQ ID NO: 28 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPVFPAAAFMVEKLVQWKYISEPVVLLLHFIITTAALLYPVFVILRCDSVVLSGVTLMLFACIVWLKLVSFTHTNYDMRALAKSIDKGDVLPDSLNTDYPYSVSFKSLAYFMVAPTLCYQTSYPRTACIRKSWVVRQLVKLIVFTGVMGFIIEQYINPIVQNSQHPLKGNLLYAIERVLKLSVPNLYVWLCMFYCFFHLWLNIVAELLRFGDREFYKDWWNAKTVEEYWRLWNMPVHKWMVRHIYFPCLRNGIPKGVAILISFFVSAIFHELCIAVPCHIFKLWAFIGIMCQVPLVLITNYLQNKFKNSMVGNMIFWFFFCILGQPMCVLLYYHDVMNRKGKTE

SEQ ID NO: 29 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaattcggttagagaatctgtcagagtcagagattcgagcaccgacgaggctctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctattttcatgcattgtatggttaaaattggtgtcttatacgcatacaaactatgatatgagagcgctggcaaaatcgattgaaaagggggatgtcctgcccgactctctgaataccgattatccttacagtgttagcttcaagagtttggcttacttcatgttagctccaaccttatgttaccagacaagctatcctcgtacggcatgcattcgaaagagttgggtggttcgtcaactattgaagttgatcgtctttacaggagttatgggattcataatagaacaatatattaatcctattgtccaaaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatgatacgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcaagaactctatggtgggaaacatgatcttctggttctttttctgtattcttggtcaacccatgtgtgtgcttctatactaccatgacttgatgaaccgtaaagggaagactgaataa

SEQ ID NO: 30 - protein, 539 aa, Corylus americana
MAISDMPESTGTTATTATMPHGGSDLRRRHNATETTEVSDSNSKTTDPDSGNSVRESVRVRDSSTDEALARKSCEDDGNRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFSCIVWLKLVSYTHTNYDMRALAKSIEKGDVLPDSLNTDYPYSVSFKSLAYFMLAPTLCYQTSYPRTACIRKSWVVRQLLKLIVFTGVMGFIIEQYINPIVQNSQHPLKGNLLYAIERVLKLSVPNLYVWLCMFYCFFHLWLNIVAELLRFGDREFYKDWWNAKTVEEYWRLWNMPVHKWMIRHIYFPCLRNGIPKGVAILIAFFVSAIFHELCIAVPCHIFKLWAFIGIMCQVPLVLITNYLQNKFKNSMVGNMIFWFFFCILGQPMCVLLYYHDLMNRKGKTE

SEQ ID NO: 31 - DNA, 1620 bp, Corylus americana
atggcgatttcggatatgcctgaaagcacgggcgccaccgccaccaccgccaccatgcctcacggcggttcggatcttcgaagacgacataacgccaccgaaaccacggaagtgtctgattcaaattctaaaacgactgatccggattccggtgattcgaaaagagaatctgtcagagtcagagattcgagcaccgacgagtccctggcccggaagacttgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggcctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccggtctttccagctgctgccttcgtagtggaaaaattagtacagtggaagtatatatctgaacctgttgttcttttacttcattttatcattaccacggcggcacttttgtatccagtttttgttattctaaaatgcgattctgtagttgtttcaggtgtcaccttgatgctatttgcttgcattgtatggttaaaattagtgtcttatacgcatacaaactatgatatgagagcgctggcaaaatcgattgaaaagggggatgtcctgcccaattctctgaataccgattatccttacagtgttagcttcaagagtttggcttacttcatggttgctccaaccttatgttaccagacaagctatcctcgtacggcatgcattcgaaagagttggttagttcgtcaactagtgaagttggtcgtctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaacacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggttcccttggttctgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 32 - protein, 539 aa, Corylus americana
MAISDMPESTGATATTATMPHGGSDLRRRHNATETTEVSDSNSKTTDPDSGDSKRESVRVRDSSTDESLARKTCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPVFPAAAFVVEKLVQWKYISEPVVLLLHFIITTAALLYPVFVILKCDSVVVSGVTLMLFACIVWLKLVSYTHTNYDMRALAKSIEKGDVLPNSLNTDYPYSVSFKSLAYFMVAPTLCYQTSYPRTACIRKSWLVRQLVKLVVFTGVMGFIIEQYINPIVKNSQHPLKGNLLYAIERVLKLSVPNLYVWLCMFYCFFHLWLNILAELLRFGDREFYKDWWNANTVEEYWRLWNMPVHKWMVRHIYFPCLRNGIPKGVAILIAFFVSAIFHELCIAVPCHMFKLWAFIGIMCQVPLVLITNYLQNKFRNSMVGNMIFWFFFCIVGQPMCVLLYYHDLMNRKGKTE

SEQ ID NO: 33 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagacttgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttatcgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttgtttcaggtgtcaccttgatgctatttgcttgcattgtatggttaaaattggtgtcttatacgcatacaaactatgatatgagagcgctggcaaaatcgattgataagggggatgtcctgcccgactctctgaataccgattatccttacagtgttagcttcaagagtttggcttacttcatgttagctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatgttcaagttgtgggcttttattggaattatgtgtcaggtccccttgttactgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 34 - protein, 539 aa, Corylus americana
MAISDMPESTGTTATTATMPHGGSDLRRRHNATETTEVSDSNSKTTDPDSGNSVRESVRVRDSSTDESLARKTCEDDGSRSEVVIESANPVTNGNDGGEKIANGEDRRTDFAAVKLAYRPSVPAHRRIKESPLSSDAIFRQSHAGLFNLCIVVLIAVNSRLIIENLMKYGWLIKTGFWFSARSLRDWPLLMCCLTLPIFPAAAFVVEKLVQWKYISEPVVLLLHFIITTAALLYPVFVILRCDSVVVSGVTLMLFACIVWLKLVSYTHTNYDMRALAKSIDKGDVLPDSLNTDYPYSVSFKSLAYFMLAPTLCYQTSYPRTACIRKSWVVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILISFFVSAIFHELCIAVPCHMFKLWAFIGIMCQVPLLLITNYLQNKFRNSMVGNMIFWFFFCIVGQPMCVLLYYHDLMNRKGKTE

SEQ ID NO: 35 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaattcggttagagaatctgtcagagtcagagattcgagcaccgacgagtccctggcccggaagacttgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccggtctttccagctgctgccttcatggtggaaaaattagtacagtggaagtatatatctgaacctgttgttcttttacttcattttatcattaccacggcggcacttttgtatccagtttttgttattctaaaatgcgattctgtagttttatcaggtgtcaccttgatgctatttgcttgcattgtatggttaaaattggtgtcttatacgcatacaaactatgatatgagagcgctggcaaaatcgattgataagggggatgtcctgcccgactctctgaataccgattatccttacagtgttagcttcaagagtttggcttacttcatgttagctccaaccttatgttaccagacaagctatcctcgtacggcatgcattcgaaagagttgggtggttcgtcaactagtgaagttggtcgtctttacaggagttatgggattcataatagaacaatatattaatcctattgtcaagaactcccaacatcccttgaaagggaaccttctatatgtcattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 36 - protein, 539 aa, Corylus americana
MAISDMPESTGTTATTATMPHGGSDLRRRHNATETTEVSDSNSKTTDPDSGNSVRESVRVRDSSTDESLARKTCEDDGSRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPVFPAAAFMVEKLVQWKYISEPVVLLLHFIITTAALLYPVFVILKCDSVVLSGVTLMLFACIVWLKLVSYTHTNYDMRALAKSIDKGDVLPDSLNTDYPYSVSFKSLAYFMLAPTLCYQTSYPRTACIRKSWVVRQLVKLVVFTGVMGFIIEQYINPIVKNSQHPLKGNLLYVIERVLKLSVPNLYVWLCMFYCFFHLWLNIVAELLRFGDREFYKDWWNAKTVEEYWRLWNMPVHKWMVRHIYFPCLRNGIPKGVAILIAFFVSAIFHELCIAVPCHMFKLWAFIGIMCQVPLVLITNYLQNKFRNSMVGNMIFWFFFCILGQPMCVLLYYHDLMNRKGKTE

SEQ ID NO: 37 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtgattcggttagagaatctgtcagagtcagagattcgagcaccgacgaggctctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccggtctttccagctgctgccttcgtagtggaaaaattagtacagtggaagtatatatctgaacctgttgttcttgtgcttcattttatcattaccacggcggcacttttgtatccagtttttgttattctaaaatgcgattctgtagttgtttcaggtgtcaccttgatgctatttgcttgcattgtatggttaaaattggtgtcttatacgcatacaaactatgatatgagagcgctggcaaaatcgattgataagggggatgtcctgccctcctctctgaataccgattatccttacagtgttagcttcaagagtttggcttacttcatggttgctccaaccttatgttaccagacaagctatcctcgtacggcatgcattcgaaagagttgggtggttcgtcaactagtgaagttggtcgtctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatgttcaagttgtgggcttttattggaattatgtgtcagatccccttggtactgattaccaattacctgcaaaataagttcaagaactctatggtgggaaacatgatcttctggttctttttctgtattgtaggtcaacccatgtgtgtgcttctatactaccatgacttgatgaaccgtaaagggaagactgaataa

SEQ ID NO: 38 - protein, 539 aa, Corylus americana
MAISDMPESTGTTATTATMPHGGSDLRRRHNATETTEVSDSNSKTTDPDSGDSVRESVRVRDSSTDEALARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPVFPAAAFVVEKLVQWKYISEPVVLVLHFIITTAALLYPVFVILKCDSVVVSGVTLMLFACIVWLKLVSYTHTNYDMRALAKSIDKGDVLPSSLNTDYPYSVSFKSLAYFMVAPTLCYQTSYPRTACIRKSWVVRQLVKLVVFTGVMGFIIEQYINPIVKNSQHPLKGNLLYAIERVLKLSVPNLYVWLCMFYCFFHLWLNIVAELLRFGDREFYKDWWNAKTVEEYWRLWNMPVHKWMVRHIYFPCLRNGIPKGVAILISFFVSAIFHELCIAVPCHMFKLWAFIGIMCQIPLVLITNYLQNKFKNSMVGNMIFWFFFCIVGQPMCVLLYYHDLMNRKGKTE

SEQ ID NO: 39 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagacttgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagtcccggctcaccgtagaataaaggagagccctcttagctccgacgcaatcctcagacagagccatgcaggtccctttaatctctgtatagtagtgcttatcgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttgtgcttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttggttagttcgtcaactagtgaagttgataatatttacaggagttatgggattcataatagaacaatatattaatcctattgtccaaaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 40 - protein, 539 aa, Corylus americana
MAISDMPESTGTTATTATMPHGGSDLRRRHNATETTEVSDSNSKTTDPDSGNSVRESVRVRDSSTDESLARKTCEDDGSRSEVVIESANPVTNGNDGGEKIANGEDRRTDFAAVKLAYRPSVPAHRRIKESPLSSDAILRQSHAGPFNLCIVVLIAVNSRLIIENLMKYGWLIKTGFWFSSRSLRDWPLLMCCLTLPIFPAAAFVVEKLVQWKYISEPVVLVLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWLVRQLVKLIIFTGVMGFIIEQYINPIVQNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHMFKLWAFIGIMCQVPLVLITNYLQNKFRNSMVGNMIFWFFFCILGQPMCVLLYYHDLMNRKGKTE

SEQ ID NO: 41 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcgggtgtcaccttgatgctatttgcttgcattgtatggttaaaattggtgtcttatacgcatacaaactatgatatgagagcgctggcaaaatcgattgaaaagggggatgtcctgcccaattctctgaataccgaatatccttacagtgttagcttcaagagtttggcttacttcatggttgctccaaccttatgttaccagacaagctatcctcgtacggcatgcattcgaaagagttgggtggttcgtcaactagtgaagttggtcatctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatattcaagttgtgggcttttattggaattatgtgtcaggtccccttggtactgattaccaattacctgcaaaataagttcagaaacactatggtgggaaacatgatcttctggttctttttctgtattgtaggtcaacccatgtgtgtgcttctatactaccatgacttgatgagccgtaaagggaagactgaataa

SEQ ID NO: 42 - protein, 539 aa, Corylus americana
MAISDMPESTGTTATTATMPHGGSDLRRRHNATETTEVSDSNSKTTDPDSGNSVRESVRVRDSSTDESLARKSCEDDGNRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPIFPAAAFVVEKLVQWKYISEPVVLLLHFIITTAALLYPVFVILRCDSVVLSGVTLMLFACIVWLKLVSYTHTNYDMRALAKSIEKGDVLPNSLNTEYPYSVSFKSLAYFMVAPTLCYQTSYPRTACIRKSWVVRQLVKLVIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILISFFVSAIFHELCIAVPCHIFKLWAFIGIMCQVPLVLITNYLQNKFRNTMVGNMIFWFFFCIVGQPMCVLLYYHDLMSRKGKTE

SEQ ID NO: 43 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccggtctttccagctgctgccttcgtagtggaaaaattagtacagtggaagtatatatctgaacctgttgttcttttacttcattttatcattaccacggcggcacttttgtatccagtttttgttattctaaaatgcgattctgtagttttatcaggtgtcaccttgatgctatttgcttgcattgtatggttaaaattggtgtcttatacgcatacaaactatgatatgagagcgctggcaaaatcgattgaaaagggggatgtcctgcccaattctctgaataccgaatatccttacagtgttagcttcaagagtttggcttacttcatgttagctccaaccttatgttaccagacaagctatcctcgtacggcatgcattcgaaggagttgggtggttcgtcaactattgaagttgatcgtctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcacatctactttccatgcctgcgaaatgggataccaaagggagttgccattctaattagtttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 44 - protein, 539 aa, Corylus americana
MAISDMPESTGTTATTATMPHGGSDLRRRHNATETTEVSDSNSKTTDPDSGNSVRESVRVRDSSTDESLARKSCEDDGNRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSSRSLRDWPLLMCCLTLPIFPAAAFMVEKLVQWKYISEPVVLLLHFIITTAALLYPVFVILRCDSVVLSGVTLMLFSCIVWLKLVSYTHTNYDMRALAKSIEKGDVLPNSLNTEYPYSVSFKSLAYFMVAPTLCYQTSYPRTACIRKSWVVRQLVKLVIFTGVMGFIIEQYINPIVKNSQHPLKGNLLYAIERVLKLSVPNLYVWLCMFYCFFHLWLNIVAELLRFGDREFYKDWWNAKTVEEYWRLWNMPVHKWMVRHIYFPCLRNGIPKGVAILISFFVSAIFHELCIAVPCHIFKLWAFIGIMCQIPLLLITNYLQNKFRNSMVGNMIFWFFFCILGQPMCVLLYYHDLMNRKGKTE

SEQ ID NO: 45 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagacttgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaaatgcgattctgtagttgtttcaggtgtcaccttgatgctatttgcttgcattgtatggttaaaattggtgtcttatacgcatacaaactatgatatgagagcgctggcaaaatcgattgaaaagggggatgtcctgcccgactctctgaataccgattatccttacagtgttagcttcaagagtttggcttacttcatgttagctccaaccttatgttaccagacaagctatcctcgtacggcatgcattcgaaagagttgggtggttcgtcaactattgaagttggtcgtctttacaggagttatgggattcataatagaacaatatattaatcctattgtccaaaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcagatccccttggtactgattaccaattacctgcaaaataagttcagaaactctatggtgggaaacatgatcttctggttctttttctgtattgtaggtcaacccatgtgtgtgcttctatactaccatgacgtcatgaaccgtaaagggaagactgaataa

SEQ ID NO: 46 - protein, 539 aa, Corylus americana
MAISDMPESTGTTATTATMPHGGSDLRRRHNATETTEVSDSNSKTTDPDSGNSVRESVRVRDSSTDESLARKTCEDDGNRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPIFPAAAFVVEKLVQWKYISEPVVLLLHFIITTAALLYPVFVILKCDSVVVSGVTLMLFACIVWLKLVSYTHTNYDMRALAKSIEKGDVLPDSLNTDYPYSVSFKSLAYFMLAPTLCYQTSYPRTACIRKSWVVRQLLKLVVFTGVMGFIIEQYINPIVQNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQIPLVLITNYLQNKFRNSMVGNMIFWFFFCIVGQPMCVLLYYHDVMNRKGKTE

SEQ ID NO: 47 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcatggtggaaaaattagtacagtggaagtatatatctgaacctgttgttcttttacttcattttatcattaccacggcggcacttttgtatccagtttttgttattctaaaatgcgattctgtagttttatcaggtgtcaccttgatgctattttcatgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgatcgtctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 48 - protein, 539 aa, Corylus americana
MAISDMPESTGTTATTATMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPIFPAAAFMVEKLVQWKYISEPVVLLLHFIITTAALLYPVFVILKCDSVVLSGVTLMLFSCIVWLKLVSYTHTNYDMRALAKSIDKGDVLPNSLNTDYPYSVSFKSLAYFMVAPTLCYQTSYPRTACIRKSWVVRQLVKLIVFTGVMGFIIEQYINPIVKNSQHPLKGNLLYAIERVLKLSVPNLYVWLCMFYCFFHLWLNIVAELLRFGDREFYKDWWNAKTVEEYWRLWNMPVHKWMVRHIYFPCLRNGIPKGVAILISFFVSAIFHELCIAVPCHIFKLWAFIGIMCQVPLVLITNYLQNKFRNSMVGNMIFWFFFCIVGQPMCVLLYYHDLMNRKGKTE

SEQ ID NO: 49 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaaatgcgattctgtagttttatcaggtgtcaccttgatgctattttcatgcattgtatggttaaaattggtgtcttatacgcatacaaactatgatatgagagcgctggcaaaatcgattgaaaagggggatgtcctgcccaattctctgaataccgattatccttacagtgttagcttcaagagtttggcttacttcatgttagctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggtccccttggtactgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 50 - protein, 539 aa, Corylus americana
MAISDMPESTGTTATTATMPHGGSDLRRRHNATETTEVSDSNSKTTDPDSGNSVRESVRVRDSSTDEALARKSCEDDGNRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPIFPAAAFVVEKLVQWKYISEPVVLLLHFIITTAALLYPVFVILKCDSVVLSGVTLMLFSCIVWLKLVSYTHTNYDMRALAKSIEKGDVLPNSLNTDYPYSVSFKSLAYFMLAPTLCYQTSYPRTACIRKSWVVRQLVKLIIFTGVMGFIIEQYINPIVKNSQHPLKGNLLYAIERVLKLSVPNLYVWLCMFYCFFHLWLNIVAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFFFCIVGQPMCVLLYYHDLMNRKGKTE

SEQ ID NO: 51 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagttagagattcgagcaccgacgagtccctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacgctcccgatatttccagctgctgccttcatggtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctattttcatgcattgtatggttaaaattggtgtcttatacgcatacaaactatgatatgagagcgctggcaaaatcgattgataagggggatgtcctgcccaattctctgaataccgaatatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 52 - protein, 539 aa, Corylus americana
MAISDMPESTGTTATTATMPHGGSDLRRRHNATETTEVSDSNSKTTDPDSGNSVRESVRVRDSSTDESLARKSCEDDGNRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPIFPAAAFMVEKLVQWKYISEPVVLLLHFIITTAALLYPVFVILRCDSVVLSGVTLMLFSCIVWLKLVSYTHTNYDMRALAKSIDKGDVLPNSLNTEYPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILISFFVSAIFHELCIAVPCHIFKLWAFIGIMCQVPLVLITNYLQNKFRNSMVGNMIFWFFFCIVGQPMCVLLYYHDLMNRKGKTE

SEQ ID NO: 53 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagtaggagcgaggttgtaattgaaaacgcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttgtgcttcattttatcattaccacggcggcacttttgtatccagtttttgttattctaaaatgcgattctgtagttgtttcaggtgtcaccttgatgctatttgcttgcattgtatggttaaaattggtgtcttttacgcatacaaactatgatatgagagcgctggcaaaatcgattgaaaagggggatgtcctgcccaattctctgaataccgattatccttacagtgttacattcaagagtttggcttacttcatgttagctccaaccttatgttaccagacaagctatcctcgtacggcatgcattcgaaagagttggttagttcgtcaactagtgaagttgatcgtctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggttcccttggttctgattaccaattacctgcaaaataagttcaagaactctatggtgggaaacatgatcttctggttctttttctgtattgtaggtcaacccatgtgtgtgcttctatactaccatgacttgatgaaccgtaaagggaagactgaataa

SEQ ID NO: 54 - protein, 539 aa, Corylus americana
MAISDMPESTGTTATTATMPHGGSDLRRRHNATETTEVSDSNSKTTDPDSGNSVRESVRVRDSSTDEALARKSCEDDGSRSEVVIENANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPIFPAAAFVVEKLVQWKYISEPVVLVLHFIITTAALLYPVFVILKCDSVVVSGVTLMLFACIVWLKLVSFTHTNYDMRALAKSIEKGDVLPNSLNTDYPYSVTFKSLAYFMLAPTLCYQTSYPRTACIRKSWLVRQLVKLIVFTGVMGFIIEQYINPIVKNSQHPLKGNLLYAIERVLKLSVPNLYVWLCMFYCFFHLWLNIVAELLRFGDREFYKDWWNAKTVEEYWRLWNMPVHKWMVRHIYFPCLRNGIPKGVAILIAFFVSAIFHELCIAVPCHMFKLWAFIGIMCQVPLVLITNYLQNKFKNSMVGNMIFWFFFCIVGQPMCVLLYYHDLMNRKGKTE

SEQ ID NO: 55 - DNA, 1620 bp, Corylus americana; identical to SEQ ID NO: 29

SEQ ID NO: 56 - protein, 539 aa, Corylus americana; identical to SEQ ID NO: 30

SEQ ID NO: 57 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcatggtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctattttcatgcattgtatggttaaaattggtgtcttatacgcatacaaactatgatatgagagcgctggcaaaatcgattgataagggggatgtcctgcccaattctctgaataccgaatatccttacagtgttagcttcaagagtttggcttacttcatgttagctccaaccttatgttaccagacaagctatcctcgtacggcatgcattcgaaagagttgggtggttcgtcaactagtgaagttggtcatctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattagtttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 58 - protein, 539 aa, Corylus americana
MAISDMPESTGTTATTATMPHGGSDLRRRHNATETTEVSDSNSKTTDPDSGNSVRESVRVRDSSTDESLARKSCEDDGNRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPIFPAAAFMVEKLVQWKYISEPVVLLLHFIITTAALLYPVFVILRCDSVVLSGVTLMLFSCIVWLKLVSYTHTNYDMRALAKSIDKGDVLPNSLNTEYPYSVSFKSLAYFMLAPTLCYQTSYPRTACIRKSWVVRQLVKLVIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILISFFVSAIFHELCIAVPCHIFKLWAFIGIMCQVPLVLITNYLQNKFRNSMVGNMIFWFFFCIVGQPMCVLLYYHDLMNRKGKTE

SEQ ID NO: 59 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactagtggaaacgacggcggtgagaagattgcgaacggtgaggatcggagaacggatttcgcggcggtgaagctcgcgttacggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattgagactggtttttggtttagttcgagatcattgagagattggccccttcttatgtgttgtcttacactcgttatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaaggggtgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactctttttttcacctctggttaaatatactggctgaacttcttcgatttggtgatcgtgggttttacgaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 60 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTSGNDGGEKIANGEDRRTDFAAVKLALRPSVPAHRRIKESPLSSDAIFRQSHAGLFNLCIVVLVAVNSRLIIENLMKYGWLIETGFWFSSRSLRDWPLLMCCLTLVIFPAAAFVVEKLVQWKYISEPVVLLLHFIITTAALLYPVFVILRCDSVVLSGVVLMLFACIVWLKLVSYAHTNYDMRALAKSIDKGDVLPNSLNTDYPYSVSFKSLAYFMVAPTLCYQTSYPRTACIRKGWVVRQLVKLIIFTGVMGFIIEQYINPIVKNSQHPLNGNLLYAIERVLKLSVPNLYVWLCMFYSFFHLWLNILAELLRFGDRGFYEDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 61 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgattcaagctccgataactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgttacggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagcggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgataatccttacagtgttagcttcaagagtttggcttacttcatggttgctccaaccttatgttaccagacaagctatcctcgtacggcatgcattcgaaaggggtgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcctttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 62 - protein, 539 aa, Corylus americana
MAISDMPESTGTTATTAAMPHGGSDLRRRHNATETTEVSDSNSKTTDSSSDNSVRESVTVRDSSTDESLARKSCEDDGSRSEVVIESANPVTNGNDGGEKIANGEDRRTDFAAVKLALRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQRKYISEPVVLLLHFIITTAALLYPVFVILRCDSVVLSGVTLMLFACIVWLKLVSYTHTNYDMRALAKSIDKGDVLPNSLNTDNPYSVSFKSLAYFMVAPTLCYQTSYPRTACIRKGWVVRQLVKLIIFTGVMGFIIEQYINPIVKNSQHPLNGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 63 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgattcaagctccggtaactcggtgagagaatctgtcagagtcagagattcgagcaccgacgagtccctggcccggaagagctgcgaggacgacgggagtaggagcgaggttgtaattgattcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctctgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacacgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccctgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 64 - protein, 539 aa, Corylus americana
MAISDMPESTGTTATTAAMPHGGSDLRRRHNATETTEVSDSNSKTTDSSSGNSVRESVRVRDSSTDESLARKSCEDDGSRSEVVIDSANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEHVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 65 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccaagctccgataactcggtgagagaatctgtcagagtcagagattcgagcaccgacgagtccctggcccggaagagctgcgaggacgacgggagtaggagcgaggttgtaattgaatcggcgaatcctgtgactaatggaaacgacgacggtgagaagattgcgaacggtgaggatcggagaatggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacacgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaaggggtgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgttccaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 66 - protein, 539 aa, Corylus americana
MAISDMPESTGTTATTATMPHGGSDLRRRHNATETTEVSDSNSKTTDPSSDNSVRESVRVRDSSTDESLARKSCEDDGSRSEVVIESANPVTNGNDDGEKIANGEDRRMDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEHVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKGWVVRQLVKLIIFTGVMGFIIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMFQVPLVLITNYLQNKFRNSMVGNMIFWFSFCILGQPMCVLLYYHDLMNRKGKTE

SEQ ID NO: 67 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatgcaaactccggtaactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttgctgctcaccgtagaataaaggagagccctcttagctccgacgcaatcttcagacagagccatgcaggtctctttaatctctgtatagtagtgcttgttgctgtgaacagtagactaatcattgagaatcttatgaagtatggttggttaattaagactggtttttggtttagttcgagatcactgagagattggccccttcttatgtgttgtcttacactcccgatatttccagctgctgccttcgtagtggaaaaattagtgcagtggaagtatatatctgaacacgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgataatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 68 - protein, 539 aa, Corylus americana
MAISDMPESTGTTATTAAMPHGGSDLRRRHNATETTEVSDSNSKTTDANSGNSVRESVTVRDSSTDESLARKSCEDDGSRSEVVIESANPVTNGNDGGEKIANGEDRRTDFAAVKLAYRPSVAAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEHVVLLLHFIITTAALLYPVFVILRCDSVVLSGVTLMLFACIVWLKLVSYTHTNYDMRALAKSIDKGDVLPNSLNTDNPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 69 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcacctcagagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatctccagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttgtgtgttgtcttacactcgttatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgataatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 70 - protein, 539 aa, Corylus americana
MAISDMPESTGTTATTAAMPHGGSDLRRRHNATETTEVSDSNSKTTDPDSGNSVRESVRVRDSSTSESLARKSCEDDGSRSEVVIESANPVTNGNDGGEKIANGEDRRTDFAAVKLAYRPSVPAHRRIKESPLSSDAISRQSHAGLFNLCIVVLVAVNSRLIIENLMKYGWLIKTGFWFSSRSLRDWPLLVCCLTLVIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDNPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 71 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccagactccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttgctgctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatgcccatacaaactatgatatgagagcgctggcaaaatcgattgataagggggatgtcctgcccaattctctgaataccgataatccttacagtgttagcttcaatagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgttccaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 72 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVAAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYAHTNYDMRALAKSIDKGDVLPNSLNTDNPYSVSFNSLAYFMVAPTLCYQTSYPRTACIRKSWVVRQLVKLIIFTGVMGFIIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMFQVPLVLITNYLQNKFRNSMVGNMIFWFSFCILGQPMCVLLYYHDLMNRKGKTE

SEQ ID NO: 73 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagcaccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtaacatggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 74 - protein, 539 aa, Corylus americana
MAISDMPESTGTTATTAAMPHGGSDLRRRHNATETTEVSDSNSKTTDPDSGNSVRESVTVRDSSTDESLARKSCEDDGSRSEVVIESANPVTNGNDGGEKIANGEDRRTDFAAVKLAYRPSVPAHRRIKESPLSTDAIFRQSHAGLFNLCIVVLVAVNSRLIIENLMKYGWLIKTGFWFSSRSLRDWPLLMCCLTLPIFPAAAFVVEKLVTWKYISEPVVLLLHFIITTAALLYPVFVILRCDSVVLSGVVLMLFACIVWLKLVSYTHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 75 - DNA, 1620 bp, Corylus americana
atggcgatttcgggtatgcctgaaagcacgggcaccaccgccaccaccgccaccatgcctcacggcggttcggatcttcgaagacgacataacgccaccgaaaccacggaagtgtctgattcaaattctaaaacgactgatccagactccggtaactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgttacggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgataatccttacagtgttagcttcaagagtttggcttacttcgtggttgctccaaccttatgttaccagacaagctatcctcgtacggcatgcattcgaaaggggtgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgttccaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 76 - protein, 539 aa, Corylus americana
MAISGMPESTGTTATTATMPHGGSDLRRRHNATETTEVSDSNSKTTDPDSGNSVRESVTVRDSSTDESLARKSCEDDGSRSEVVIESANPVTNGNDGGEKIANGEDRRTDFAAVKLALRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYAHTNYDMRALAKSIDKGDVLPNSLNTDNPYSVSFKSLAYFVVAPTLCYQTSYPRTACIRKGWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMFQVPLVLITNYLQNKFRNSMVGNMIFWFSFCILGQPMCVLLYYHDLMNRKGKTE

SEQ ID NO: 77 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaagcgactgatccagactccgataactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcgttatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 78 - protein, 539 aa, Corylus americana
MAISDMPESTGTTATTAAMPHGGSDLRRRHNATETTEVSDSNSKATDPDSDNSVRESVTVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLVIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 79 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccaagctccggtaactcggtgagagaatctgtcagagtcagagattcgagcacctcagagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaaggggtggatggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 80 - protein, 539 aa, Corylus americana
MAISDMPESTGTTATTAAMPHGGSDLRRRHNATETTEVSDSNSKTTDPSSGNSVRESVRVRDSSTSESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYAHTNYDMRALAKSIDKGDVLPNSLNTDYPYSVSFKSLAYFMVAPTLCYQTSYPRTACIRKGWMVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 81 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatgcccatacaaactatgatatgagagcgctggcaaaatcgattgataagggggatgtcctgcccaattctctgaataccgataatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcggttccgaatttatatgtgtggttttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 82 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYAHTNYDMRALAKSIDKGDVLPNSLNTDNPYSVSFKSLAYFMVAPTLCYQTSYPRTACIRKSWVVRQLVKLIIFTGVMGFIIEQYINPIVKNSQHPLNGNLLYAIERVLKLSVPNLYVWFCMFYSFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 83 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcgttatatttccagctgctgccttcgtagtggaaaaattagtaacatggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgataatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactccttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 84 - protein, 539 aa, Corylus americana
MAISDMPESTGTTATTATMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLVIFPAAAFVVEKLVTWKYISEPVVLLLHFIITTAALLYPVFVILRCDSVVLSGVVLMLFACIVWLKLVSYAHTNYDMRALAKSIDKGDVLPNSLNTDNPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 85 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgattcaagctccgataactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcacggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 86 - protein, 539 aa, Corylus americana
MAISDMPESTGTTATTATMPHGGSDLRRRHNATETTEVSDSNSKTTDSSSDNSVRESVTVRDSSTDESLARKSCEDDGSRSEVVIESANPVTNGNDGGEKIANGEDRRTDFTAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYTHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 87 - DNA, 1620 bp, Corylus americana
atggcgatttcggatatgcctgaaagcacgggcaccaccgccaccaccgccaccatgcctcacggtggttcggatcttcgaagacgacataacgccaccgaaaccacggaagtgtctgattcaaattctaaaacgactgatccagactccgataactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgttacggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacacgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctacatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtccgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 88 - protein, 539 aa, Corylus americana
MAISDMPESTGTTATTATMPHGGSDLRRRHNATETTEVSDSNSKTTDPDSDNSVRESVRVRDSSTDESLARKSCEDDGSRSEVVIESANPVTNGNDGGEKIANGEDRRTDFAAVKLALRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEHVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLKGNLLHAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 89 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacggctgatccggattccggtaactcggtgagagaatctgtcagagtcagagattcgagcaccgacgagtccctggcccggaagagctgcgaggacgacgggagtaggagcgaggttgtaattaattcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcgttatatttccagctgctgccttcgtagtggaaaaattagtacagtggaagtatatatctgaacacgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccaaccttatgttaccagacaagctatcctcgtacggcatgcattcgaaagggttgggtggttcgtcaattagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgtttataagtggatggttcgtcatatctactttccatgcctgcgaaatgggataccaaaggcagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 90 - protein, 539 aa, Corylus americana
MAISDMPESTGTTATTAAMPHGGSDLRRRHNATETTEVSDSNSKTADPDSGNSVRESVRVRDSSTDESLARKSCEDDGSRSEVVINSANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLVIFPAAAFVVEKLVQWKYISEHVVLLLHFIITTAALLYPVFVILRCDSVVLSGVVLMLFACIVWLKLVSYTHTNYDMRALAKSIDKGDVLPNSLNTDYPYSVSFNSLAYFMVAPTLCYQTSYPRTACIRKGWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVYKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 91 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcatcgagagattggccccttcttatgtgttgtcttaccctcccgatacttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtccaaaactcccaacatcccttgaacgggaaccttctatatgccattgagagggttctgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 92 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSSRDWPLLMCCLTLPILPAAAFVVEKLVQWKYISEPVVLLLHFIITTAALLYPVFVILRCDSVVLSGVVLMLFACIVWLKLVSYAHTNYDMRALAKSIDKGDVLPNSLNTDYPYSVSFKSLAYFMVAPTLCYQTSYPRTACIRKSWVVRQLVKLIIFTGVMGFIIEQYINPIVQNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFFFCILGQPMCVLLYYHDLMNRKGKTE

SEQ ID NO: 93 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaagagcgaggttgtaattaattcggcgaatcctgtgactaatggaaacgacggcggtgagaagattgcgaacggtgaggatcggagaacggatttcgcggcggtaaagctcgcgtatcggccatcagttgctgctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtaacatggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 94 - protein, 539 aa, Corylus americana
MAISDMPESTGTTATTATMPHGGSDLRRRHNATETTEVSDSNSKTTDPDSGNSVRESVRVRDSSTDESLARKSCEDDGSKSEVVINSANPVTNGNDGGEKIANGEDRRTDFAAVKLAYRPSVAAHRRIKESPLSSDAIFRQSHAGLFNLCIVVLVAVNSRLIIENLMKYGWLIKTGFWFSSRSLRDWPLLMCCLTLPIFPAAAFVVEKLVTWKYISEPVVLLLHFIITTAALLYPVFVILRCDSVVLSGVVLMLFACIVWLKLVSYAHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 95 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagggctgcgaggacgacgggagtaggagcgaggttgtaattaattcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgcctccgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 96 - protein, 539 aa, Corylus americana
MAISDMPESTGTTATTATMPHGGSDLRRRHNATETTEVSDSNSKTTDPDSGNSVRESVRVRDSSTDESLARKGCEDDGSRSEVVINSANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAASVVEKLVQWKYISEPVVLLLHFIITTAALLYPVFVILRCDSVVLSGVVLMLFACIVWLKLVSYTHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 97 - DNA, 1620 bp, Corylus americana
atggcgatttcggatatgcctgaaagcacggacaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 98 - protein, 539 aa, Corylus americana
MAISDMPESTDTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFFFCILGQPMCVLLYYHDLMNRKGKTE

SEQ ID NO: 99 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatggaccgtaaagggaagactgaataa

SEQ ID NO: 100 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYAHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMDRKGKTE

SEQ ID NO: 101 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcactgtcagagattcgagcaccgacgagcccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagtcccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtacgagatcattgagagattggccccttcttatgtgttgtcttacactcccgatatttccagctgctgccttcgtagtggaaaaattagtacagtggaggtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 102 - protein, 539 aa, Corylus americana
MAISDMPESTGTTATTATMPHGGSDLRRRHNATETTEVSDSNSKTTDPDSGNSVRESVTVRDSSTDEPLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSTRSLRDWPLLMCCLTLPIFPAAAFVVEKLVQWRYISEPVVLLLHFIITTAALLYPVFVILRCDSVVLSGVVLMLFACIVWLKLVSYAHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 103 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaatagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcccattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgcgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 104 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYAHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFASAIFHELCIAVPCHIFKLWAFIGIMCQVPLVLITNYLQNKFRNSMVGNMIFWFFFCILGQPMCVLLYYHDLMNRKGKTE

SEQ ID NO: 105 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttctcttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcgttcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 106 - protein, 539 aa, Corylus americana
MAISDMPESTGTTATTATMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACVRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 107 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccaaccttatgttatcagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtgggtggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 108 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYTHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWVVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 109 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattaattcggcgaatcctgtgactaatggaaacgacggcggtgagaagattgcgaacggtgaggatcggagaacggatttcgcggcggtgcagctcgcgtatcggccatcagttgctgctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccgaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 110 - protein, 539 aa, Corylus americana
MAISDMPESTGTTATTATMPHGGSDLRRRHNATETTEVSDSNSKTTDPDSGNSVRESVRVRDSSTDESLARKSCEDDGSRSEVVINSANPVTNGNDGGEKIANGEDRRTDFAAVQLAYRPSVAAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYTHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 111 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactagtcattgagaatcttatgaagtatggttggttaattaagactggtttttggtttagttcgagatcatcgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccaaccttatgttaccagacaagctatcctcgcacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 112 - protein, 539 aa, Corylus americana
MAISDMPESTGTTATTATMPHGGSDLRRRHNATETTEVSDSNSKTTDPDSGNSVRESVTVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLVIENLMKYGWLIKTGFWFSSRSSRDWPLLMCCLTLPIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 113 - DNA, 1620 bp, Corylus americana
atggcgatttcggatatgcttgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgccactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagccgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatgcccatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 114 - protein, 539 aa, Corylus americana
MAISDMLESTGTTATTATMPHGGSDLRRRHNATETTEVSDSNSKTTDPDSGNSVRESATVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYAHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 115 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccgactcaccgtagaataaaggagagccctcttagctccgacgcaatcctcagacagagccatgcaggtctctttaatctctgtatagtagtgcttgttgctgtgaacagcagactaatcattgagaatctcatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgccttgttgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaacgggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 116 - protein, 539 aa, Corylus americana
MAISDMPESTGTTATTAAMPHGGSDLRRRHNATETTEVSDSNSKTTDPDSGNSVRESVTVRDSSTDESLARKSCEDDGSRSEVVIESANPVTNGNDGGEKIANGEDRRTDFAAVKLAYRPSVPTHRRIKESPLSSDAILRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVALLLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLNGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 117 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcactgtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcgactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggccgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 118 - protein, 539 aa, Corylus americana
MAISDMPESTGTTATTAAMPHGGSDLRRRHNATETTEVSDSNSKTTDPDSGNSVRESVTVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYTHTNYDMRALAKSIDKGDVLPNSLNTDYPYSVSFKSLAYFMVAPTLCYQTSYPRTACIRKSWVVRRLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 119 - DNA, 1620 bp, Corylus americana
atggcgatttcggatatgcctgaaagcacgggcaccaccgccaccaccgccgccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccgtgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcgtattgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaatagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggccgttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttcagtttctgtattcttggtcaacccatgtgtgtgcttctatactaccatgacttgatgaaccgtaaagggaagactgaataa

SEQ ID NO: 120 - protein, 539 aa, Corylus americana
MAISDMPESTGTTATTAAMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSRAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFACIVWLKLVSYTHTNYDMRALAKSIDKGDVLPNSLNTDYPYSVSFNSLAYFMVAPTLCYQTSYPRTACIRKSWVVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKAVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 121 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccagactccgataactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgttacggccatcagttccggctcaccgtagaataaaggagagccctcttagctccgacgcaatcctcagacagagccatgcaggtctctttaatctctgtatagtagtgcttgttgctgtgaacagcagactaatcattgagaatcttatgaagtatggttggttaattaagactggtttttggtttagttcgggatcattgagagattggccccttcttatgtgttgtcttacactcccgatatttccagctgctgccttcgtagtggaaaaattagtacagtggaagtatatatcggaacctgttgttcttttacttcattttatcattaccacggcggcacttttgtatccagtttttgttattctaaggtgcgattctgtagttttatcaggtgtcaccttgatgctatttgcttcaattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaaggggtgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgttccaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 122 - protein, 539 aa, Corylus americana
MAISDMPESTGTTATTATMPHGGSDLRRRHNATETTEVSDSNSKTTDPDSDNSVRESVRVRDSSTDESLARKSCEDDGSRSEVVIESANPVTNGNDGGEKIANGEDRRTDFAAVKLALRPSVPAHRRIKESPLSSDAILRQSHAGLFNLCIVVLVAVNSRLIIENLMKYGWLIKTGFWFSSGSLRDWPLLMCCLTLPIFPAAAFVVEKLVQWKYISEPVVLLLHFIITTAALLYPVFVILRCDSVVLSGVTLMLFASIVWLKLVSYTHTNYDMRALAKSIDKGDVLPNSLNTDYPYSVSFKSLAYFMVAPTLCYQTSYPRTACIRKGWVVRQLVKLIIFTGVMGFIIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMFQVPLVLITNYLQNKFRNSMVGNMIFWFFFCILGQPMCVLLYYHDLMNRKGKTE

SEQ ID NO: 123 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgtcagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaagcatgatcttctggttctttttctgtattcttggtcaacccatgtgtgtgcttctatactaccatgacttgatgaaccgtaaagggaagactgaataa

SEQ ID NO: 124 - protein, 539 aa, Corylus americana
MAISDMPESTGTTATTATMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGSMIFWFFFCILGQPMCVLLYYHDLMNRKGKTE

SEQ ID NO: 125 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgattcagactccgataactcggtgagagaatctgtcagagtcagagattcgagcacctcagagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttcaattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 126 - protein, 539 aa, Corylus americana
MAISDMPESTGTTATTATMPHGGSDLRRRHNATETTEVSDSNSKTTDSDSDNSVRESVRVRDSSTSESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFASIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFFFCILGQPMCVLLYYHDLMNRKGKTE

SEQ ID NO: 127 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccaagctccgataactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgttacggccatcagttccggcccaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacacgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaaggggtgggtggttcgtcaactagtgaagttgataatatttacaggagttatgggattcatgatagaacaatatattaatcctattgtcaagaactcccaacatcccttgaaagggaaccttctatatgccattgagagggttttgaagctttcagttccgaatttatatgtgtggctttgcatgttctactctttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgttccaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 128 - protein, 539 aa, Corylus americana
MAISDMPESTGTTATTATMPHGGSDLRRRHNATETTEVSDSNSKTTDPSSDNSVRESVRVRDSSTDESLARKSCEDDGSRSEVVIESANPVTNGNDGGEKIANGEDRRTDFAAVKLALRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEHVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKGWVVRQLVKLIIFTGVMGFMIEQYINPIVKNSQHPLKGNLLYAIERVLKLSVPNLYVWLCMFYSFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMFQVPLVLITNYLQNKFRNSMVGNMIFWFFFCILGQPMCVLLYYHDLMNRKGKTE

SEQ ID NO: 129 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccagactccggtaactcggtgagagaatctgtcagagtcagagattcgagcaccgacgagtccctggcccggaagagctgcgaggacgacgggagtaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataataaaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 130 - protein, 539 aa, Corylus americana
MAISDMPESTGTTATTATMPHGGSDLRRRHNATETTEVSDSNSKTTDPDSGNSVRESVRVRDSSTDESLARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIKQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFFFCILGQPMCVLLYYHDLMNRKGKTE

SEQ ID NO: 131 - DNA, 1620 bp, Corylus americana
atggcgatttcggatatgcctgaaagcacgggcaccaccgccaccaccgccgctatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagcaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttccagatcattgagagattggccccttcttatgtgttgtcttacactcccgatatttccagctgctgccttcgtagtggaaaaattagtacagtggaagtatatatctgaacctgttgttcttgttcttcattttatcattaccacggcggcacttttgtatccagtttttgttattctaagatgcgattctgtagttttatcaggtgtcgtgttgatgctattttcatgcattgtatggttaaaattggtgtcttatacgcatacaaactatgatatgagagcgctggcaaaatcgattgaaaagggggatgtcctgcccaattctctgaataccgattatccttacagtgttactttcaagagtttggcttacttcatgttagctccaaccttatgttaccagacaagctatcctcgtacggcatgcattcgaaagagttgggtggttcgtcaactagtgaagttgataatatttacaggagttatgggattcataatagaacaatatattaatcctattgtccaaaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggtccccttggtactgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 132 - protein, 539 aa, Corylus americana
MAISDMPESTGTTATTAAMPHGGSDLRRRHNATETTEVSDSNSKTTDPDSGNSVRESVRVRDSSTDEALARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLVLHFIITTAALLYPVFVILRCDSVVLSGVVLMLFSCIVWLKLVSYTHTNYDMRALAKSIEKGDVLPNSLNTDYPYSVTFKSLAYFMLAPTLCYQTSYPRTACIRKSWVVRQLVKLIIFTGVMGFIIEQYINPIVQNSQHPLKGNLLYAIERVLKLSVPNLYVWLCMFYSFFHLWLNIVAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFFFCIVGQPMCVLLYYHDLMNRKGKTE

SEQ ID NO: 133 - DNA, 1620 bp, Corylus americana
atggcgatttcggatatgcctgaaagcacgggcaccaccgccaccaccgccgctatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagtgaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttccagatcattgagagattggccccttcttatgtgttgtcttacactcccgatatttccagctgctgccttcgtagtggaaaaattagtacagtggaagtatatatctgaacctgttgttcttgttcttcattttatcattaccacggcggcacttttgtatccagtttttgttattctaaaatgcgattctgtagttttatcaggtgtcaccttgatgctattttcatgcattgtatggttaaaattggtgtcttttacgcatacaaactatgatatgagagcgctggcaaaatcgattgaaaagggggatgtcctgcccgattctctgaataccgattatccttacagtgttagcttcaagagtttggcttacttcatgttagctccaaccttatgttaccagacaagctatcctcgtacggcatgcattcgaaagagttgggtggttcgtcaactactgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatgatacgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggtccccttggtactgattaccaattacctgcaaaataagttcagaaactctatggtgggaaacatgatcttctggttctcattctgtattgtaggtcaacccatgtgtgtgcttctatactaccatgacttgatgaaccgtaaagggaagactgaataa

SEQ ID NO: 134 - protein, 539 aa, Corylus americana
MAISDMPESTGTTATTAAMPHGGSDLRRRHNATETTEVSDSNSKTTDPDSGNSVRESVRVRDSSTDEALARKSCEDDGNRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLVLHFIITTAALLYPVFVILKCDSVVLSGVTLMLFSCIVWLKLVSFTHTNYDMRALAKSIEKGDVLPDSLNTDYPYSVSFKSLAYFMLAPTLCYQTSYPRTACIRKSWVVRQLLKLIIFTGVMGFIIEQYINPIVKNSQHPLKGNLLYAIERVLKLSVPNLYVWLCMFYSFFHLWLNIVAELLRFGDREFYKDWWNAKTVEEYWRLWNMPVHKWMIRHIYFPCLRNGIPKGVAILIAFFVSAIFHELCIAVPCHIFKLWAFIGIMCQVPLVLITNYLQNKFRNSMVGNMIFWFSFCIVGQPMCVLLYYHDLMNRKGKTE

SEQ ID NO: 135 - DNA, 1620 bp, Corylus americana
atggcgatttcggatatgcctgaaagcacgggcaccaccgccaccaccgccgctatgcctcacggcggttcggatcttcgaagacgacataacgccaccgcaaccacggaagtgtctgattcaaattctaaaacgactgatccggattccggtaactcggtgagagaatctgtcagagtcagagattcgagcaccgacgaggctctggcccggaagagctgcgaggacgacgggagcaggagcgaggttgtaattgaaaatgcgaatcctgtgactaatggaaacgacggcggtgagaagattgcgaacggtgaggatcggagaacggatttcgcggcggtgaagctcgcgtatcggccatcagttccggctcaccgtagagtgaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaaatgcgattctgtagttttatcaggtgtcaccttgatgctattttcatgcattgtatggttaaaattggtgtcttttacgcatacaaactatgatatgagagcgctggcaaaatcgattgaaaagggggatgtcctgcccaattctctgaataccgattatccttacagtgttagcttcaagagtttggcttacttcatgttagctccaaccttatgttaccagacaagctatcctcgtacggcatgcattcgaaagagttgggtggttcgtcaactagtgaagttgataatatttacaggagttatgggattcataatagaacaatatattaatcctattgtccaaaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggtccccttggtactgattaccaattacctgcaaaataagttcagaaactctatggtgggaaacatgatcttctggttctcattctgtattgtaggtcaacccatgtgtgtgcttctatactaccatgacttgatgaaccgtaaagggaagactgaataa

SEQ ID NO: 136 - protein, 539 aa, Corylus americana
MAISDMPESTGTTATTAAMPHGGSDLRRRHNATATTEVSDSNSKTTDPDSGNSVRESVRVRDSSTDEALARKSCEDDGSRSEVVIENANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPIFPAAAFVVEKLVQWKYISEPVVLLLHFIITTAALLYPVFVILKCDSVVLSGVTLMLFSCIVWLKLVSFTHTNYDMRALAKSIEKGDVLPNSLNTDYPYSVSFKSLAYFMLAPTLCYQTSYPRTACIRKSWVVRQLVKLIIFTGVMGFIIEQYINPIVQNSQHPLKGNLLYAIERVLKLSVPNLYVWLCMFYSFFHLWLNIVAELLRFGDREFYKDWWNAKTVEEYWRLWNMPVHKWMVRHIYFPCLRNGIPKGVAILIAFFVSAIFHELCIAVPCHMFKLWAFIGIMCQVPLVLITNYLQNKFRNSMVGNMIFWFSFCIVGQPMCVLLYYHDLMNRKGKTE

SEQ ID NO: 137 - DNA, 1620 bp, Corylus americana
atggcgatttcggatatgcctgaaagcacgggcaccaccgccaccaccgccaccatgcctcacggcggttcggatcttcgaagacgacctgcagccaccgaaaccacggaagtgtctgattcaaattctaaaacgactgatccggattccggtaactcggtgagagaatctgtcagagtcagagattcgagcaccgacgaggctctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaaatgcgattctgtagttttatcaggtgtcgtgttgatgctattttcatgcattgtatggttaaaattggtgtcttttacgcatacaaactatgatatgagagcgctggcaaaatcgattgaaaagggggatgtcctgcccaattctctgaataccgattatccttacagtgttagcttcaagagtttggcttacttcatgttagctccaaccttatgttaccagacaagctatcctcgtacggcatgcattcgaaagagttgggtggttcgtcaactagtgaagttgataatatttacaggagttatgggattcataatagaacaatatattaatcctattgtcaagaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggtccccttggtactgattaccaattacctgcaaaataagttcagaaactctatggtgggaaacatgatcttctggttctcattctgtattgtaggtcaacccatgtgtgtgcttctatactaccatgacttgatgaaccgtaaagggaagactgaataa

SEQ ID NO: 138 - protein, 539 aa, Corylus americana
MAISDMPESTGTTATTATMPHGGSDLRRRPAATETTEVSDSNSKTTDPDSGNSVRESVRVRDSSTDEALARKSCEDDGNRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPIFPAAAFVVEKLVQWKYISEPVVLLLHFIITTAALLYPVFVILKCDSVVLSGVVLMLFSCIVWLKLVSFTHTNYDMRALAKSIEKGDVLPNSLNTDYPYSVSFKSLAYFMLAPTLCYQTSYPRTACIRKSWVVRQLVKLIIFTGVMGFIIEQYINPIVKNSQHPLKGNLLYAIERVLKLSVPNLYVWLCMFYSFFHLWLNIVAELLRFGDREFYKDWWNAKTVEEYWRLWNMPVHKWMVRHIYFPCLRNGIPKGVAILIAFFVSAIFHELCIAVPCHMFKLWAFIGIMCQVPLVLITNYLQNKFRNSMVGNMIFWFSFCIVGQPMCVLLYYHDLMNRKGKTE

SEQ ID NO: 139 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagcaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaagatgcgattctgtagttttatcaggtgtcgtgttgatgctattttcatgcattgtatggttaaaattggtgtcttatacgcatacaaactatgatatgagagcgctggcaaaatcgattgaaaagggggatgtcctgcccaattctctgaataccgattatccttacagtgttactttcaagagtttggcttacttcatgttagctccaaccttatgttaccagacaagctatcctcgtacggcatgcattcgaaagagttgggtggttcgtcaactactgaagttgatagtttttacaggagttatgggattcataatagaacaatatattaatcctattgtccaaaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatgatacgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggtccccttggtactgattaccaattacctgcaaaataagttcagaaactctatggtgggaaacatgatcttctggttctcattctgtattttgggtcaacccatgtgtgtgcttctatactaccatgacttgatgaaccgtaaagggaagactgaataa

SEQ ID NO: 140 - protein, 539 aa, Corylus americana
MAISDMPESTGTTATTATMPHGGSDLRRRHNATETTEVSDSNSKTTDPDSGNSVRESVRVRDSSTDEALARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVVLMLFSCIVWLKLVSYTHTNYDMRALAKSIEKGDVLPNSLNTDYPYSVTFKSLAYFMLAPTLCYQTSYPRTACIRKSWVVRQLLKLIVFTGVMGFIIEQYINPIVQNSQHPLKGNLLYAIERVLKLSVPNLYVWLCMFYSFFHLWLNIVAELLRFGDREFYKDWWNAKTVEEYWRLWNMPVHKWMIRHIYFPCLRNGIPKGVAILIAFFVSAIFHELCIAVPCHMFKLWAFIGIMCQVPLVLITNYLQNKFRNSMVGNMIFWFSFCILGQPMCVLLYYHDLMNRKGKTE

SEQ ID NO: 141 - DNA, 1620 bp, Corylus americana
atggcgatttcggatatgcctgaaagcacgggcaccaccgccaccaccgccaccatgcctcacggcggttcggatcttcgaagacgacctgcagccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagcaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagtgaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaaatgcgattctgtagttgtatcaggtgtcgtgttgatgctattttcatgcattgtatggttaaaattggtgtcttttacgcatacaaactatgatatgagagcgctggcaaaatcgattgaaaagggggatgtcctgcccaattctctgaataccgattatccttacagtgttagcttcaagagtttggcttacttcatgttagctccaaccttatgttaccagacaagctatcctcgtacggcatgcattcgaaagagttgggtggttcgtcaactagtgaagttgatagtttttacaggagttatgggattcataatagaacaatatattaatcctattgtcaagaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggcagttgccattctaattgccttctttgtgtctgccatattccatgagctctgcatagctgttccatgccacatgttcaagttgtgggcttttattggaattatgtgtcaggtccccttggtactgattaccaattacctgcaaaataagttcagaaactctatggtgggaaacatgatcttctggttctttttctgtattgtaggtcaacccatgtgtgtgcttctatactaccatgacttgatgaaccgtaaagggaagactgaataa

SEQ ID NO: 142 - protein, 539 aa, Corylus americana
MAISDMPESTGTTATTATMPHGGSDLRRRPAATETTEVSDSNSKTTDPDSGNSVRESVRVRDSSTDEALARKSCEDDGSRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSARSLRDWPLLMCCLTLPIFPAAAFVVEKLVQWKYISEPVVLLLHFIITTAALLYPVFVILKCDSVVVSGVVLMLFSCIVWLKLVSFTHTNYDMRALAKSIEKGDVLPNSLNTDYPYSVSFKSLAYFMLAPTLCYQTSYPRTACIRKSWVVRQLVKLIVFTGVMGFIIEQYINPIVKNSQHPLKGNLLYAIERVLKLSVPNLYVWLCMFYSFFHLWLNIVAELLRFGDREFYKDWWNAKTVEEYWRLWNMPVHKWMVRHIYFPCLRNGIPKAVAILIAFFVSAIFHELCIAVPCHMFKLWAFIGIMCQVPLVLITNYLQNKFRNSMVGNMIFWFFFCIVGQPMCVLLYYHDLMNRKGKTE

SEQ ID NO: 143 - DNA, 1620 bp, Corylus americana
atggcgatttcggatatgcctgaaagcacgggcaccaccgccaccaccgccaccatgcctcacggcggttcggatcttcgaagacgacctgcagccaccgaaaccacggaagtgtctgattcaaattctaaaacgactgatccggattccggtaactcggtgagagaatctgtcagagtcagagattcgagcaccgacgaggctctggcccggaagagctgcgaggacgacgggaataggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagtgaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttccagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaaatgcgattctgtagttttatcaggtgtcgtgttgatgctatttgcatgcattgtatggttaaaattggtgtcttatacgcatacaaactatgatatgagagcgctggcaaaatcgattgaaaagggggatgtcctgcccaattctctgaataccgattatccttacagtgttactttcaagagtttggcttacttcatgttagctccaaccttatgttaccagacaagctatcctcgtacggcatgcattcgaaagagttgggtggttcgtcaactactgaagttgataatttttacaggagttatgggattcataatagaacaatatattaatcctattgtccaaaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaaggcagttgccattctaattgccttctttgtgtctgccatattccatgagctctgcatagctgttccatgccacatgttcaagttgtgggcttttattggaattatgtgtcaggtccccttggtactgattaccaattacctgcaaaataagttcagaaactctatggtgggaaacatgatcttctggttctcattctgtattgtaggtcaacccatgtgtgtgcttctatactaccatgacttgatgaaccgtaaagggaagactgaataa

SEQ ID NO: 144 - protein, 539 aa, Corylus americana
MAISDMPESTGTTATTATMPHGGSDLRRRPAATETTEVSDSNSKTTDPDSGNSVRESVRVRDSSTDEALARKSCEDDGNRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLLLHFIITTAALLYPVFVILKCDSVVLSGVVLMLFACIVWLKLVSYTHTNYDMRALAKSIEKGDVLPNSLNTDYPYSVTFKSLAYFMLAPTLCYQTSYPRTACIRKSWVVRQLLKLIIFTGVMGFIIEQYINPIVQNSQHPLKGNLLYAIERVLKLSVPNLYVWLCMFYSFFHLWLNIVAELLRFGDREFYKDWWNAKTVEEYWRLWNMPVHKWMVRHIYFPCLRNGIPKAVAILIAFFVSAIFHELCIAVPCHMFKLWAFIGIMCQVPLVLITNYLQNKFRNSMVGNMIFWFSFCIVGQPMCVLLYYHDLMNRKGKTE

SEQ ID NO: 145 - DNA, 1620 bp, Corylus americana
atggcgatttcggatatgcctgaaagcacgggcaccaccgccaccaccgccaccatgcctcacggcggttcggatcttcgaagacgacctgcagccaccgaaaccacggaagtgtctgattcaaattctaaaacgactgatccggattccggtaactcggtgagagaatctgtcagagtcagagattcgagcaccgacgaggctctggcccggaagagctgcgaggacgacgggaataggagcgaggttgtaattgaaaatgcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttgttcttcattttatcattaccacggcggcacttttgtatccagtttttgttattctaaaatgcgattctgtagttgtatcaggtgtcaccttgatgctatttgcatgcattgtatggttaaaattggtgtcttatacgcatacaaactatgatatgagagcgctggcaaaatcgattgaaaagggggatgtcctgcccaattctctgaataccgattatccttacagtgttagcttcaagagtttggcttacttcatgttagctccaaccttatgttaccagacaagctatcctcgtacggcatgcattcgaaagagttgggtggttcgtcaactactgaagttgatagtttttacaggagttatgggattcataatagaacaatatattaatcctattgtccaaaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatgatacgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggtccccttggtactgattaccaattacctgcaaaataagttcagaaactctatggtgggaaacatgatcttctggttctcattctgtattgtaggtcaacccatgtgtgtgcttctatactaccatgacttgatgaaccgtaaagggaagactgaataa

SEQ ID NO: 146 - protein, 539 aa, Corylus americana
MAISDMPESTGTTATTATMPHGGSDLRRRPAATETTEVSDSNSKTTDPDSGNSVRESVRVRDSSTDEALARKSCEDDGNRSEVVIENANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPIFPAAAFVVEKLVQWKYISEPVVLVLHFIITTAALLYPVFVILKCDSVVVSGVTLMLFACIVWLKLVSYTHTNYDMRALAKSIEKGDVLPNSLNTDYPYSVSFKSLAYFMLAPTLCYQTSYPRTACIRKSWVVRQLLKLIVFTGVMGFIIEQYINPIVQNSQHPLKGNLLYAIERVLKLSVPNLYVWLCMFYCFFHLWLNIVAELLRFGDREFYKDWWNAKTVEEYWRLWNMPVHKWMIRHIYFPCLRNGIPKGVAILIAFFVSAIFHELCIAVPCHMFKLWAFIGIMCQVPLVLITNYLQNKFRNSMVGNMIFWFSFCIVGQPMCVLLYYHDLMNRKGKTE

SEQ ID NO: 147 - DNA, 1620 bp, Corylus americana
atggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagcaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagagtgaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagttccagatcattgagagattggccccttcttatgtgttgtcttacactcccgatatttccagctgctgccttcgtagtggaaaaattagtacagtggaagtatatatctgaacctgttgttcttgttcttcattttatcattaccacggcggcacttttgtatccagtttttgttattctaaaatgcgattctgtagttttatcaggtgtcaccttgatgctatttgcatgcattgtatggttaaaattggtgtcttatacgcatacaaactatgatatgagagcgctggcaaaatcgattgaaaagggggatgtcctgcccaattctctgaataccgattatccttacagtgttactttcaagagtttggcttacttcatgttagctccaaccttatgttaccagacaagctatcctcgtacggcatgcattcgaaagagttgggtggttcgtcaactactgaagttgatagtttttacaggagttatgggattcataatagaacaatatattaatcctattgtcaagaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatgagacgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggtccccttggtactgattaccaattacctgcaaaataagttcagaaactctatggtgggaaacatgatcttctggttctcattctgtattttgggtcaacccatgtgtgtgcttctatactaccatgacttgatgaaccgtaaagggaagactgaataa

SEQ ID NO: 148 - protein, 539 aa, Corylus americana
MAISDMPESTGTTATTATMPHGGSDLRRRHNATETTEVSDSNSKTTDPDSGNSVRESVRVRDSSTDEALARKSCEDDGSRSEVVIESANPVTNGNDGGEKIANGEDRRTDFAAVKLAYRPSVPAHRRVKESPLSSDAIFRQSHAGLFNLCIVVLVAVNSRLIIENLMKYGWLIKTGFWFSSRSLRDWPLLMCCLTLPIFPAAAFVVEKLVQWKYISEPVVLVLHFIITTAALLYPVFVILKCDSVVLSGVTLMLFACIVWLKLVSYTHTNYDMRALAKSIEKGDVLPNSLNTDYPYSVTFKSLAYFMLAPTLCYQTSYPRTACIRKSWVVRQLLKLIVFTGVMGFIIEQYINPIVKNSQHPLKGNLLYAIERVLKLSVPNLYVWLCMFYSFFHLWLNIVAELLRFGDREFYKDWWNAKTVEEYWRLWNMPVHKWMRRHIYFPCLRNGIPKGVAILIAFFVSAIFHELCIAVPCHIFKLWAFIGIMCQVPLVLITNYLQNKFRNSMVGNMIFWFSFCILGQPMCVLLYYHDLMNRKGKTE

SEQ ID NO: 149 - DNA, 1620 bp, Corylus americana
atggcgatttcggatatgcctgaaagcacgggcaccaccgccaccaccgccgctatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagcaggagcgaggttgtaattgaatcggcgaatcctgtgactaatggaaacgacggcggtgagaagattgcgaacggtgaggatcggagaacggatttcgcggcggtgaagctcgcgtatcggccatcagttccggctcaccgtagaataaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttgttcttcattttatcattaccacggcggcacttttgtatccagtttttgttattctaaaatgcgattctgtagttgtatcaggtgtcgtgttgatgctattttcatgcattgtatggttaaaattggtgtcttatacgcatacaaactatgatatgagagcgctggcaaaatcgattgaaaagggggatgtcctgcccaattctctgaataccgattatccttacagtgttagcttcaagagtttggcttacttcatgttagctccaaccttatgttaccagacaagctatcctcgtacggcatgcattcgaaagagttggttagttcgtcaactactgaagttgataatatttacaggagttatgggattcataatagaacaatatattaatcctattgtccaaaactcccaacatcccttgaaagggaaccttctatatgccattgagagggttttgaagctttcagttccgaatttatatgtgtggctttgcatgttctacagtttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggtccccttggtactgattaccaattacctgcaaaataagttcagaaactctatggtgggaaacatgatcttctggttctcattctgtattgtaggtcaacccatgtgtgtgcttctatactaccatgacttgatgaaccgtaaagggaagactgaataa

SEQ ID NO: 150 - protein, 539 aa, Corylus americana
MAISDMPESTGTTATTAAMPHGGSDLRRRHNATETTEVSDSNSKTTDPDSGNSVRESVRVRDSSTDEALARKSCEDDGSRSEVVIESANPVTNGNDGGEKIANGEDRRTDFAAVKLAYRPSVPAHRRIKESPLSSDAIFRQSHAGLFNLCIVVLVAVNSRLIIENLMKYGWLIKTGFWFSARSLRDWPLLMCCLTLPIFPAAAFVVEKLVQWKYISEPVVLVLHFIITTAALLYPVFVILKCDSVVVSGVVLMLFSCIVWLKLVSYTHTNYDMRALAKSIEKGDVLPNSLNTDYPYSVSFKSLAYFMLAPTLCYQTSYPRTACIRKSWLVRQLLKLIIFTGVMGFIIEQYINPIVQNSQHPLKGNLLYAIERVLKLSVPNLYVWLCMFYSFFHLWLNIVAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFSFCIVGQPMCVLLYYHDLMNRKGKTE

SEQ ID NO: 151 - DNA, 9065 bp, Artificial Sequence
  plasmid PHP35885
gacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctcttgtgcagttagacgcgaatttttcgaagaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaactagtggatccatggcgatttcggatatgcctgaaagcacgggcaccaccgccaccaccgccaccatgcctcacggcggttcggatcttcgaagacgacataacgccaccgaaaccacggaagtgtctgattcaaattctaaaacgactgatccggattccggtaactcggtgagagaatctgtcagagtcagagattcgagcaccgacgaggctctggcccggaagagctgcgaggacgacgggagtaggagcgaggttgtaattgaaaacgcgaatcctgtgactaatggaaacgacggcggtgagaagattgcgaacggtgaggatcggagaacggatttcgcggcggtgaagctcgcgtatcggccatcagttccggctcaccgtagagttaaggagagccctcttagctccgacgcaatcttcagacagagccatgcaggtctctttaatctctgtatagtagtgcttgttgctgtgaacagcagactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttgtgcttcattttatcattaccacggcggcacttttgtatccagtttttgttattctaaaatgcgattctgtagttgtttcaggtgtcaccttgatgctatttgcttgcattgtatggttaaaattggtgtcttttacgcatacaaactatgatatgagagcgctggcaaaatcgattgaaaagggggatgtcctgcccaattctctgaataccgattatccttacagtgttacattcaagagtttggcttacttcatgttagctccaaccttatgttaccagacaagctatcctcgtacggcatgcattcgaaagagttggttagttcgtcaactagtgaagttgatcgtctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggttcccttggttctgattaccaattacctgcaaaataagttcaagaactctatggtgggaaacatgatcttctggttctttttctgtattgtaggtcaacccatgtgtgtgcttctatactaccatgacttgatgaaccgtaaagggaagactgaataagaattcgatatcaagcttatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcggttttaattttgtttcttcttcttcttcttcttcaattaacaatgtgccttcatcatttttcatttctttcagttcttctaattctcttggagacaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 152 - DNA, 1515 bp, Glycine max
atggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagttcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaggtgtgattctgcttttgtatcaggtgtcacgttaatgctgttttcttgtgttgtatggttaaaattggtgtcttatgcacatacaaactatgatatgagagcacttaccaaattagttgaaaagggagaagcactgctcgatactctgaacatggactatccttacaacgtaagcttcaagagcttggcatatttcctggttgcccctacattatgttaccagccaagctatcctcgcacaccttatattcgaaagggttggttgtttcgccaacttgtcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcctggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatattcaagttgtgggctttcggtggaattatgtttcaggttcctttggtcttgatcactaattatctgcaaaataaattcagaaactcaatggttggaaatatgattttttggttcatattcagtatccttggtcaacctatgtgtgtactgctatactaccatgacttgatgaataggaaaggcaaacttgactga

SEQ ID NO: 153 - protein, 504 aa, Glycine max
MAISDEPESVATALNHSSLRRRPSATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQRKCIPEPVVVVLHIIITSTSLFYPVLVILRCDSAFVSGVTLMLFSCVVWLKLVSYAHTNYDMRALTKLVEKGEALLDTLNMDYPYNVSFKSLAYFLVAPTLCYQPSYPRTPYIRKGWLFRQLVKLIIFTGVMGFIIEQYINPIVQNSQHPLKGNLLYATERVLKLSVPNLYVWLCMFYCFFHLWLNILAELLRFGDREFYKDWWNAKTVEDYWRMWNMPVHKWMIRHLYFPCLRHGLPKAAALLIAFLVSALFHELCIAVPCHIFKLWAFGGIMFQVPLVLITNYLQNKFRNSMVGNMIFWFIFSILGQPMCVLLYYHDLMNRKGKLD

SEQ ID NO: 154 - DNA, 1515 bp, Glycine max
atggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcacgttaatgctgttttcttgtgttgtatggttaaaattggtgtcttatgcacatacaaactatgatatgagagcacttaccaaattagttgaaaagggagaagcactgctcgatactctgaacatggactatccttacaacgtaagcttcaagagcttggcatatttcctgcttgcccctacattatgttaccagccaagctatcctcgcacaccttatattcgaaagggttggttgtttcgccaacttgtcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatattcaagttgtgggctttcggtggaattatgtttcaggttcctttggtcttgatcactaattatctgcaaaataaattcagaaactcaatggttggaaatatgattttttggttcatattcagtatcgttggtcaacctatgtgtgtactgctatactaccatgacttgatgaataggaaaggcaaacttgactga

SEQ ID NO: 155 - protein, 504 aa, Glycine max
MAISDEPESVATALNHSSLRRRPSATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFIVEKLAQRKCIPEPVVVVLHIIITSTSLFYPVLVILKCDSAFVSGVTLMLFSCVVWLKLVSYAHTNYDMRALTKLVEKGEALLDTLNMDYPYNVSFKSLAYFLLAPTLCYQPSYPRTPYIRKGWLFRQLVKLIIFTGVMGFIIEQYINPIVQNSQHPLKGNLLYATERVLKLSVPNLYVWLCMFYCFFHLWLNIVAELLRFGDREFYKDWWNAKTVEDYWRMWNMPVHKWMIRHLYFPCLRHGLPKAAALLIAFLVSALFHELCIAVPCHIFKLWAFGGIMFQVPLVLITNYLQNKFRNSMVGNMIFWFIFSIVGQPMCVLLYYHDLMNRKGKLD

SEQ ID NO: 156 - DNA, 1515 bp, Glycine max
atggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatggtggagaagttggcacaacggaagtgtatacccgaaccagttgttgttgtacttcatataatcattacctcaacttcgcttttctatccagttttagttattctcaggtgtgattctgcttttgtatcaggtgtcacgttaatgctgttttcttgtgttgtatggttaaaattggtgtcttatgcacatacaaactatgatatgagagcacttaccaaattagttgaaaagggagaagcactgctcgatactctgaacatggagtatccttacaacgtaagcttcaagagcttggcatatttcctggttgcccctacattatgttaccagccaagctatcctcgcacaccttatattcgaaagggttggttgtttcgccaacttgtcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcctggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaatttccttcctggtttctgctttattccatgagctgtgcattgctgttccttgccacatattcaagttgtgggctttcggtggaattatgtttcaggttcctttggtcttgatcactaattatctgcaaaataaattcagaaactcaatggttggaaatatgattttttggttcatattcagtatcgttggtcaacctatgtgtgtactgctatactaccatgacttgatgaataggaaaggcaaacttgactga

SEQ ID NO: 157 - protein, 504 aa, Glycine max
MAISDEPESVATALNHSSLRRRPSATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFMVEKLAQRKCIPEPVVVVLHIIITSTSLFYPVLVILRCDSAFVSGVTLMLFSCVVWLKLVSYAHTNYDMRALTKLVEKGEALLDTLNMEYPYNVSFKSLAYFLVAPTLCYQPSYPRTPYIRKGWLFRQLVKLIIFTGVMGFIIEQYINPIVQNSQHPLKGNLLYATERVLKLSVPNLYVWLCMFYCFFHLWLNILAELLRFGDREFYKDWWNAKTVEDYWRMWNMPVHKWMIRHLYFPCLRHGLPKAAALLISFLVSALFHELCIAVPCHIFKLWAFGGIMFQVPLVLITNYLQNKFRNSMVGNMIFWFIFSIVGQPMCVLLYYHDLMNRKGKLD

SEQ ID NO: 158 - DNA, 1515 bp, Glycine max
atggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacaacgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcacgttaatgctgttttcttgtgttgtatggttaaaattggtgtcttttgcacatacaaactatgatatgagagcacttaccaaattagttgaaaagggagaagcactgctcgatactctgaacatggactatccttacaacgtaaccttcaagagcttggcatatttcctgcttgcccctacattatgttaccagccaagctatcctcgcacaccttatattcgaaagggttggttgtttcgccaacttgtcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatgttcaagttgtgggctttcggtggaattatgtttcaggttcctttggtcttgatcactaattatctgcaaaataaattcaaaaactcaatggttggaaatatgattttttggttcatattcagtatcgttggtcaacctatgtgtgtactgctatactaccatgacttgatgaataggaaaggcaaacttgactga

SEQ ID NO: 159 - protein, 504 aa, Glycine max
MAISDEPESVATALNHSSLRRRPSATSTAGLFNSPETTTDSSGDDLAKDSGSDDSINNDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFIVEKLAQRKCIPEPVVVVLHIIITSTSLFYPVLVILKCDSAFVSGVTLMLFSCVVWLKLVSFAHTNYDMRALTKLVEKGEALLDTLNMDYPYNVTFKSLAYFLLAPTLCYQPSYPRTPYIRKGWLFRQLVKLIVFTGVMGFIIEQYINPIVQNSQHPLKGNLLYATERVLKLSVPNLYVWLCMFYCFFHLWLNIVAELLRFGDREFYKDWWNAKTVEDYWRMWNMPVHKWMIRHLYFPCLRHGLPKAAALLIAFLVSALFHELCIAVPCHMFKLWAFGGIMFQVPLVLITNYLQNKFKNSMVGNMIFWFIFSIVGQPMCVLLYYHDLMNRKGKLD

SEQ ID NO: 160 - DNA, 1515 bp, Glycine max
atggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacaacgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatggtggagaagttggcacaacggaagtgtatacccgaaccagttgttgttgtacttcatataatcattacctcaacttcgcttttctatccagttttagttattctcaagtgtgattctgcttttgtatcaggtgtcacgttaatgctgttttcttgtgttgtatggttaaaattggtgtcttttgcacatacaaactatgatatgagagcacttaccaaattagttgaaaagggagaagcactgctcgatactctgaacatggagtatccttacaacgtaaccttcaagagcttggcatatttcctgcttgcccctacattatgttaccagccaagctatcctcgcacaccttatattcgaaagggttggttgtttcgccaacttgtcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaatttccttcctggtttctgctttattccatgagctgtgcattgctgttccttgccacatgttcaagttgtgggctttcggtggaattatgtttcaggttcctttggtcttgatcactaattatctgcaaaataaattcaaaaactcaatggttggaaatatgattttttggttcatattcagtatcgttggtcaacctatgtgtgtactgctatactaccatgacttgatgaataggaaaggcaaacttgactga

SEQ ID NO: 161 - protein, 504 aa, Glycine max
MAISDEPESVATALNHSSLRRRPSATSTAGLFNSPETTTDSSGDDLAKDSGSDDSINNDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFMVEKLAQRKCIPEPVVVVLHIIITSTSLFYPVLVILKCDSAFVSGVTLMLFSCVVWLKLVSFAHTNYDMRALTKLVEKGEALLDTLNMEYPYNVTFKSLAYFLLAPTLCYQPSYPRTPYIRKGWLFRQLVKLIVFTGVMGFIIEQYINPIVQNSQHPLKGNLLYATERVLKLSVPNLYVWLCMFYCFFHLWLNIVAELLRFGDREFYKDWWNAKTVEDYWRMWNMPVHKWMIRHLYFPCLRHGLPKAAALLISFLVSALFHELCIAVPCHMFKLWAFGGIMFQVPLVLITNYLQNKFKNSMVGNMIFWFIFSIVGQPMCVLLYYHDLMNRKGKLD

SEQ ID NO: 162 - DNA, 1485 bp, Zea mays
atggctccgccaccctccatgcctgcagcctccgatcgcgctggccctggacgcgacgcaggcgactcgtcctcccttcgcctccgcagggctccctcagccgacgctggcgaccttgccggagattcctcgggaggcttgcgggagaacggcgagccgcaatcgccgacgaatccgccaccgcaggagcagcagcagcacgagatgctatactacagggcgtcggctccagcccaccgcagggtcaaggagagcccactcagctctgacgccatcttccggcagagccatgctggtcttctgaatctatgcattgttgttctgatcgcagtgaacagtcgactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtactatctggatttgtgctaatgtttcttgcgagcatcatgtggatgaagcttgtctcttatgcacatacaaattatgatataagggtattgtccaaaagtactgaaaagggtgctgcatatggaaattatgtcgatcctgagaatatgaaagatccaacctttaaaagtctagtgtactttatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattgcttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtatttcatgagatatgtattgcggtgccttgccacattttcaaattctgggcattttctgggatcatgtttcagatacccttggtattcttgacaagatatctccatgctacgttcaagcatgtaatggtgggcaacatgatattttggttcttcttcagtatagtcggacagccgatgtgtgtccttctatactaccatgacgtcatgaacaggcaggcccaggcaagtagatag

SEQ ID NO: 163 - DNA, 1485 bp, Zea mays
atggctccgccaccctccatgcctgcagcctccgatcgcgctggccctggacgcgacgcaggcgactcgtcctcccttcgcctccgcagggctccctcagccgacgctggcgaccttgccggagattcctcgggaggcttgcgggagaacggcgagccgcaatcgccgacgaatccgccaccgcaggagcagcagcagcacgagatgctatactacagggcgtcggctccagcccaccgcagggtcaaggagagcccactcagctctgacgccatcttccggcagagccatgctggtcttctgaatctatgcattgttgttctgatcgcagtgaacagtcgactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtactatctggatttgtgctaatgtttcttgcgagcatcatgtggatgaagcttgtctcttatgcacatacaaattatgatataagggtattgtccaaaagtactgaaaagggtgctgcatatggaaattatgtcgatcctgagaatatgaaagatccaacctttaaaagtctagtgtactttatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattgcttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtatttcatgagatatgtattgcggtgccttgccacattttcaaattctgggcattttctgggatcatgtttcagatacccttggtattcttgacaagatatctccatgctacgttcaagcatgtaatggtgggcaacatgatattttggttctccttcagtatagtcggacagccgatgtgtgtccttctatactaccatgacgtcatgaacaggcaggcccaggcaagtagatag

SEQ ID NO: 164 - protein, 494 aa, Zea mays
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYCFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFSFSIVGQPMCVLLYYHDVMNRQAQASR

SEQ ID NO: 165 - DNA, 1485 bp, Zea mays
atggctccgccaccctccatgcctgcagcctccgatcgcgctggccctggacgcgacgcaggcgactcgtcctcccttcgcctccgcagggctccctcagccgacgctggcgaccttgccggagattcctcgggaggcttgcgggagaacggcgagccgcaatcgccgacgaatccgccaccgcaggagcagcagcagcacgagatgctatactacagggcgtcggctccagcccaccgcagggtcaaggagagcccactcagctctgacgccatcttccggcagagccatgctggtcttctgaatctatgcattgttgttctgatcgcagtgaacagtcgactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtactatctggatttgtgctaatgtttcttgcgagcatcatgtggatgaagcttgtctcttatgcacatacaaattatgatataagggtattgtccaaaagtactgaaaagggtgctgcatatggaaattatgtcgatcctgagaatatgaaagatccaacctttaaaagtctagtgtactttatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattccttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtatttcatgagatatgtattgcggtgccttgccacattttcaaattctgggcattttctgggatcatgtttcagatacccttggtattcttgacaagatatctccatgctacgttcaagcatgtaatggtgggcaacatgatattttggttcttcttcagtatagtcggacagccgatgtgtgtccttctatactaccatgacgtcatgaacaggcaggcccaggcaagtagatag

SEQ ID NO: 166 - protein, 494 aa, Zea mays
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYSFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFFFSIVGQPMCVLLYYHDVMNRQAQASR

SEQ ID NO: 167 - DNA, 1485 bp, Zea mays
atggctccgccaccctccatgcctgcagcctccgatcgcgctggccctggacgcgacgcaggcgactcgtcctcccttcgcctccgcagggctccctcagccgacgctggcgaccttgccggagattcctcgggaggcttgcgggagaacggcgagccgcaatcgccgacgaatccgccaccgcaggagcagcagcagcacgagatgctatactacagggcgtcggctccagcccaccgcagggtcaaggagagcccactcagctctgacgccatcttccggcagagccatgctggtcttctgaatctatgcattgttgttctgatcgcagtgaacagtcgactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtactatctggatttgtgctaatgtttcttgcgagcatcatgtggatgaagcttgtctcttatgcacatacaaattatgatataagggtattgtccaaaagtactgaaaagggtgctgcatatggaaattatgtcgatcctgagaatatgaaagatccaacctttaaaagtctagtgtactttatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattccttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtatttcatgagatatgtattgcggtgccttgccacattttcaaattctgggcattttctgggatcatgtttcagatacccttggtattcttgacaagatatctccatgctacgttcaagcatgtaatggtgggcaacatgatattttggttctccttcagtatagtcggacagccgatgtgtgtccttctatactaccatgacgtcatgaacaggcaggcccaggcaagtagatag

SEQ ID NO: 168 - protein, 494 aa, Zea mays
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYSFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFSFSIVGQPMCVLLYYHDVMNRQAQASR

SEQ ID NO: 169 - DNA, 1485 bp, Zea mays
atggctccgccaccctccatgcctgcagcctccgatcgcgctggccctggacgcgacgcaggcgactcgtcctcccttcgcctccgcagggctccctcagccgacgctggcgaccttgccggagattcctcgggaggcttgcgggagaacggcgagccgcaatcgccgacgaatccgccaccgcaggagcagcagcagcacgagatgctatactacagggcgtcggctccagcccaccgcagggtcaaggagagcccactcagctctgacgccatcttccggcagagccatgctggtcttctgaatctatgcattgttgttctgatcgcagtgaacagtcgactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtagtctctggatttgtgctaatgtttcttgcgagcatcatgtggatgaagcttgtctcttatgcacatacaaattatgatataagggtattgtccaaaagtactgaaaagggtgctgcatatggagactatgtcgatcctgagaatatgaaagatccaacctttaaaagtctagtgtactttatgttggccccaacactttgttaccagccaacttatcctcaaactacatgtattagaaagggttgggtgacccagcaactcataaagtgcgtggtttttacaggcttgatgggcttcataattgagcaatatataaacccaattgtgcagaattccaaacatccactgaaagggaattttttgaatgctatagaaagagtcttaaaactctcagtgccaacattatatgtatggctttgcatgttctattccttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccagggccgtagctattctaatctcgtttctggtttcagctgtatttcatgagatatgtattgcggtgccttgccacattttcaaattctgggcattttctgggatcatgtttcagatacccttggtattcttgacaagatatctccatgctacgttcaagcatgtaatggtgggcaacatgatattttggttctccttcagtatagtcggacagccgatgtgtgtccttctatactaccatgacgtcatgaacaggcaggcccaggcaagtagatag

SEQ ID NO: 170 - protein, 494 aa, Zea mays
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVVSGFVLMFLASIMWMKLVSYAHTNYDIRVLSKSTEKGAAYGDYVDPENMKDPTFKSLVYFMLAPTLCYQPTYPQTTCIRKGWVTQQLIKCVVFTGLMGFIIEQYINPIVQNSKHPLKGNFLNAIERVLKLSVPTLYVWLCMFYSFFHLWLNIVAELLCFGDREFYKDWWNAKTVEEYWRMWNMPVHKWIIRHIYFPCIRKGFSRAVAILISFLVSAVFHEICIAVPCHIFKFWAFSGIMFQIPLVFLTRYLHATFKHVMVGNMIFWFSFSIVGQPMCVLLYYHDVMNRQAQASR

SEQ ID NO: 171 - DNA, 8948 bp, Artificial Sequence
  plasmid PHP40102
gacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctcttgtgcagttagacgcgaatttttcgaagaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaactagtggatccatggctccgccaccctccatgcctgcagcctccgatcgcgctggccctggacgcgacgcaggcgactcgtcctcccttcgcctccgcagggctccctcagccgacgctggcgaccttgccggagattcctcgggaggcttgcgggagaacggcgagccgcaatcgccgacgaatccgccaccgcaggagcagcagcagcacgagatgctatactacagggcgtcggctccagcccaccgcagggtcaaggagagcccactcagctctgacgccatcttccggcagagccatgctggtcttctgaatctatgcattgttgttctgatcgcagtgaacagtcgactcattattgagaatttaatgaagtatggcctgttgataagagctggattttggtttagtgcaagatcgctgggtgactggccccttctaatgtgctgcctcactctaccagttttcccactagttgcactcatggctgagaagctgatcacaagaaagctcattggtgaacatgtggttattctactccatatcattattacaacatctgccattgtctatccagttgttgtgactcttaagtgtgactcagcagtactatctggatttgtgctaatgtttcttgcgagcatcatgtggatgaagcttgtctcttatgcacatacaaattatgatataagggtattgtccaaaagtactgaaaagggtgctgcatatggaaattatgtcgatcctgagaatatgaaagatccaacctttaaaagtctagtgtactttatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattccttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtatttcatgagatatgtattgcggtgccttgccacattttcaaattctgggcattttctgggatcatgtttcagatacccttggtattcttgacaagatatctccatgctacgttcaagcatgtaatggtgggcaacatgatattttggttctccttcagtatagtcggacagccgatgtgtgtccttctatactaccatgacgtcatgaacaggcaggcccaggcaagtagataggcatgccccgggctgcaggaattcgatatcaagcttatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcggttttaattttgtttcttcttcttcttcttcttcaattaacaatgtgccttcatcatttttcatttctttcagttcttctaattctcttggagacaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 172 - DNA, 1482 bp, Artificial Sequence
  ZM-DGAT:CA-DGAT1 CHIMERA
atggccccgcccccctccatgcctgccgcctccgatcgcgccggccctggccgcgacgcgggcgactcgtcctcccttcgcctccgccgcgccccctcagccgacgccggcgaccttgccggcgattcctcgggaggcttgcgggagaacggcgagccgcaatcgccgacgaatccgccgccgcaggagcagcagcagcacgagatgctatactaccgcgcgtcggcgcccgcccaccgccgcgtcaaggagagccccctcagctctgacgccatcttccggcagagccatgctggtcttctgaatctatgcattgttgttctgatcgcagtgaacagtcgactaatcattgagaatcttatgaagtatggttggttaattaagactggtttttggtttagttcgagatcattgagagattggccccttcttatgtgttgtcttacactcccgatatttccagctgctgccttcgtagtggaaaaattagtacagtggaagtatatatctgaacctgttgttcttttacttcattttatcattaccacggcggcacttttgtatccagtttttgttattctaaggtgcgattctgtagttttatcaggtgtcaccttgatgctatttgcttgcattgtatggttaaaattggtgtcttatacgcatacaaactatgatatgagagcgctggcaaaatcgattgataagggggatgtcctgcccaattctctgaataccgattatccttacagtgttagcttcaagagtttggcttacttcatggttgctccaaccttatgttaccagacaagctatcctcgtacggcatgcattcgaaagagttgggtggttcgtcaactagtgaagttgataatatttacaggagttatgggattcataatagaacaatatattaatcctattgtcaagaattcccaacatcccttgaaagggaaccttctatatgccattgagagggttttgaagctttcagttccgaatttatatgtgtggctttgcatgttctactgcttttttcacctctggttaaatatactggctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatattcaagttgtgggcttttattggaattatgtgtcaggttcccttggttctgattaccaattacctgcaaaataagttcagaaactctatggtgggaaacatgatcttctggttctttttctgtattcttggtcaacccatgtgtgtgcttctatactaccatgacttgatgaaccgtaaagggaagactgaataa

SEQ ID NO: 173 - protein, 493 aa, Artificial Sequence
  ZM-DGAT:CA-DGAT1 CHIMERA
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGWLIKTGFWFSSRSLRDWPLLMCCLTLPIFPAAAFVVEKLVQWKYISEPVVLLLHFIITTAALLYPVFVILRCDSVVLSGVTLMLFACIVWLKLVSYTHTNYDMRALAKSIDKGDVLPNSLNTDYPYSVSFKSLAYFMVAPTLCYQTSYPRTACIRKSWVVRQLVKLIIFTGVMGFIIEQYINPIVKNSQHPLKGNLLYAIERVLKLSVPNLYVWLCMFYCFFHLWLNILAELLRFGDREFYKDWWNAKTVEEYWRLWNMPVHKWMVRHIYFPCLRNGIPKGVAILIAFFVSAIFHELCIAVPCHIFKLWAFIGIMCQVPLVLITNYLQNKFRNSMVGNMIFWFFFCILGQPMCVLLYYHDLMNRKGKTE

SEQ ID NO: 174 - DNA, 1482 bp, Artificial Sequence
  ZM-DGAT:CA-DGAT1-C11 CHIMERA
atggccccgcccccctccatgcctgccgcctccgatcgcgccggccctggccgcgacgcgggcgactcgtcctcccttcgcctccgccgcgccccctcagccgacgccggcgaccttgccggcgattcctcgggaggcttgcgggagaacggcgagccgcaatcgccgacgaatccgccgccgcaggagcagcagcagcacgagatgctatactaccgcgcgtcggcgcccgcccaccgccgcgtcaaggagagccccctcagctctgacgccatcttccggcagagccatgctggtcttctgaatctatgcattgttgttctgatcgcagtgaacagtcgactaatcattgagaatcttatgaagtatggttggttaattaagactggtttttggtttagtgccagatcattgagagattggccccttcttatgtgttgtcttacactcccgatatttccagctgctgccttcgtagtggaaaaattagtacagtggaagtatatatctgaacctgttgttcttgtgcttcattttatcattaccacggcggcacttttgtatccagtttttgttattctaaaatgcgattctgtagttgtttcaggtgtcaccttgatgctatttgcttgcattgtatggttaaaattggtgtcttttacgcatacaaactatgatatgagagcgctggcaaaatcgattgaaaagggggatgtcctgcccaattctctgaataccgattatccttacagtgttacattcaagagtttggcttacttcatgttagctccaaccttatgttaccagacaagctatcctcgtacggcatgcattcgaaagagttggttagttcgtcaactagtgaagttgatcgtctttacaggagttatgggattcataatagaacaatatattaatcctattgtcaagaactcccaacatcccttgaaagggaaccttctatatgccattgagagggttttgaagctttcagttccgaatttatatgtgtggctttgcatgttctactgcttttttcacctctggttaaatatagtagctgaacttcttcgatttggtgatcgtgagttttacaaagattggtggaatgcgaagacagttgaagagtattggagattgtggaatatgcctgttcataagtggatggttcgtcatatctactttccatgcctgcgaaatgggataccaaagggagttgccattctaattgccttctttgtgtctgccatattccatgagctctgcatagctgttccatgccacatgttcaagttgtgggcttttattggaattatgtgtcaggttcccttggttctgattaccaattacctgcaaaataagttcaagaactctatggtgggaaacatgatcttctggttctttttctgtattgtaggtcaacccatgtgtgtgcttctatactaccatgacttgatgaaccgtaaagggaagactgaataa

SEQ ID NO: 175 - protein, 493 aa, Artificial Sequence
  ZM-DGAT:CA-DGAT1-C11 CHIMERA
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGWLIKTGFWFSARSLRDWPLLMCCLTLPIFPAAAFVVEKLVQWKYISEPVVLVLHFIITTAALLYPVFVILKCDSVVVSGVTLMLFACIVWLKLVSFTHTNYDMRALAKSIEKGDVLPNSLNTDYPYSVTFKSLAYFMLAPTLCYQTSYPRTACIRKSWLVRQLVKLIVFTGVMGFIIEQYINPIVKNSQHPLKGNLLYAIERVLKLSVPNLYVWLCMFYCFFHLWLNIVAELLRFGDREFYKDWWNAKTVEEYWRLWNMPVHKWMVRHIYFPCLRNGIPKGVAILIAFFVSAIFHELCIAVPCHMFKLWAFIGIMCQVPLVLITNYLQNKFKNSMVGNMIFWFFFCIVGQPMCVLLYYHDLMNRKGKTE

SEQ ID NO: 176 - protein, 15 aa, Corylus americana
NGNDGGEKIANGEDR

SEQ ID NO: 177 - protein, 16 aa, Zea mays
RLRRAPSADAGDLAGD

SEQ ID NO: 178 - DNA, 7085 bp, Artificial Sequence
  plasmid pKR72
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctc

SEQ ID NO: 179 - DNA, 8611 bp, Artificial Sequence
  plasmid pKR1466
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagttcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaggtgtgattctgcttttgtatcaggtgtcacgttaatgctgttttcttgtgttgtatggttaaaattggtgtcttatgcacatacaaactatgatatgagagcacttaccaaattagttgaaaagggagaagcactgctcgatactctgaacatggactatccttacaacgtaagcttcaagagcttggcatatttcctggttgcccctacattatgttaccagccaagctatcctcgcacaccttatattcgaaagggttggttgtttcgccaacttgtcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcctggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatattcaagttgtgggctttcggtggaattatgtttcaggttcctttggtcttgatcactaattatctgcaaaataaattcagaaactcaatggttggaaatatgattttttggttcatattcagtatccttggtcaacctatgtgtgtactgctatactaccatgacttgatgaataggaaaggcaaacttgactgagc

SEQ ID NO: 180 - DNA, 8611 bp, Artificial Sequence
  plasmid pKR1515
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcacgttaatgctgttttcttgtgttgtatggttaaaattggtgtcttatgcacatacaaactatgatatgagagcacttaccaaattagttgaaaagggagaagcactgctcgatactctgaacatggactatccttacaacgtaagcttcaagagcttggcatatttcctgcttgcccctacattatgttaccagccaagctatcctcgcacaccttatattcgaaagggttggttgtttcgccaacttgtcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatattcaagttgtgggctttcggtggaattatgtttcaggttcctttggtcttgatcactaattatctgcaaaataaattcagaaactcaatggttggaaatatgattttttggttcatattcagtatcgttggtcaacctatgtgtgtactgctatactaccatgacttgatgaataggaaaggcaaacttgactgagc

SEQ ID NO: 181 - DNA, 8611 bp, Artificial Sequence
  plasmid pKR1516
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatggtggagaagttggcacaacggaagtgtatacccgaaccagttgttgttgtacttcatataatcattacctcaacttcgcttttctatccagttttagttattctcaggtgtgattctgcttttgtatcaggtgtcacgttaatgctgttttcttgtgttgtatggttaaaattggtgtcttatgcacatacaaactatgatatgagagcacttaccaaattagttgaaaagggagaagcactgctcgatactctgaacatggagtatccttacaacgtaagcttcaagagcttggcatatttcctggttgcccctacattatgttaccagccaagctatcctcgcacaccttatattcgaaagggttggttgtttcgccaacttgtcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcctggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaatttccttcctggtttctgctttattccatgagctgtgcattgctgttccttgccacatattcaagttgtgggctttcggtggaattatgtttcaggttcctttggtcttgatcactaattatctgcaaaataaattcagaaactcaatggttggaaatatgattttttggttcatattcagtatcgttggtcaacctatgtgtgtactgctatactaccatgacttgatgaataggaaaggcaaacttgactgagc

SEQ ID NO: 182 - DNA, 8611 bp, Artificial Sequence
  plasmid pKR1517
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacaacgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcacgttaatgctgttttcttgtgttgtatggttaaaattggtgtcttttgcacatacaaactatgatatgagagcacttaccaaattagttgaaaagggagaagcactgctcgatactctgaacatggactatccttacaacgtaaccttcaagagcttggcatatttcctgcttgcccctacattatgttaccagccaagctatcctcgcacaccttatattcgaaagggttggttgtttcgccaacttgtcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatgttcaagttgtgggctttcggtggaattatgtttcaggttcctttggtcttgatcactaattatctgcaaaataaattcaaaaactcaatggttggaaatatgattttttggttcatattcagtatcgttggtcaacctatgtgtgtactgctatactaccatgacttgatgaataggaaaggcaaacttgactgagc

SEQ ID NO: 183 - DNA, 8611 bp, Artificial Sequence
  plasmid pKR1520
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacaacgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatggtggagaagttggcacaacggaagtgtatacccgaaccagttgttgttgtacttcatataatcattacctcaacttcgcttttctatccagttttagttattctcaagtgtgattctgcttttgtatcaggtgtcacgttaatgctgttttcttgtgttgtatggttaaaattggtgtcttttgcacatacaaactatgatatgagagcacttaccaaattagttgaaaagggagaagcactgctcgatactctgaacatggagtatccttacaacgtaaccttcaagagcttggcatatttcctgcttgcccctacattatgttaccagccaagctatcctcgcacaccttatattcgaaagggttggttgtttcgccaacttgtcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattgctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaatttccttcctggtttctgctttattccatgagctgtgcattgctgttccttgccacatgttcaagttgtgggctttcggtggaattatgtttcaggttcctttggtcttgatcactaattatctgcaaaataaattcaaaaactcaatggttggaaatatgattttttggttcatattcagtatcgttggtcaacctatgtgtgtactgctatactaccatgacttgatgaataggaaaggcaaacttgactgagc

SEQ ID NO: 184 - DNA, 1515 bp, Glycine max
atggcgatttccgatgagcctgaaagtgtagccactgctctcaaccactcttccctgcgccgccgtcccgccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcgtgttaatgctgttttcttgtgttgtatggttaaaattggtgtcttttgcacatacaaactatgatatgagagcacttaccaaattagttgaaaagggagaagcactgctcgatactctgaacatggactatccttacaacgtaagcttcaagagcttggcatatttcctgcttgcccctacattatgttaccagccaagctatcctcgcacaccttatattcgaaagggttggttgtttcgccaacttgtcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattcctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatgttcaagttgtgggctttcggtggaattatgtttcaggttcctttggtcttgatcactaattatctgcaaaataaattcagaaactcaatggttggaaatatgattttttggttcagtttcagtatcgttggtcaacctatgtgtgtactgctatactaccatgacttgatgaataggaaaggcaaacttgactga

SEQ ID NO: 185 - protein, 504 aa, Glycine max
MAISDEPESVATALNHSSLRRRPAATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFIVEKLAQRKCIPEPVVVVLHIIITSTSLFYPVLVILKCDSAFVSGVVLMLFSCVVWLKLVSFAHTNYDMRALTKLVEKGEALLDTLNMDYPYNVSFKSLAYFLLAPTLCYQPSYPRTPYIRKGWLFRQLVKLIIFTGVMGFIIEQYINPIVQNSQHPLKGNLLYATERVLKLSVPNLYVWLCMFYSFFHLWLNIVAELLRFGDREFYKDWWNAKTVEDYWRMWNMPVHKWMIRHLYFPCLRHGLPKAAALLIAFLVSALFHELCIAVPCHMFKLWAFGGIMFQVPLVLITNYLQNKFRNSMVGNMIFWFSFSIVGQPMCVLLYYHDLMNRKGKLD

SEQ ID NO: 186 - DNA, 1515 bp, Glycine max
atggcgatttccgatgagcctgaaagtgtagccactgctctcaaccactcttccctgcgccgccgtcccgccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcgtgttaatgctgttttcttgtgttgtatggttaaaattggtgtcttttgcacatacaaactatgatatgagagcacttaccaaattagttgaaaagggagaagcactgctcgatactctgaacatggactatccttacaacgtaagcttcaagagcttggcatatttcctgcttgcccctacattatgttaccagccaagctatcctcgcacaccttatattcgaaagggttggttgtttcgccaacttgtcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattcctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatgttcaagttgtgggctttcggtggaattatgtttcaggttcctttggtcttgatcactaattatctgcaaaataaattcagaaactcaatggttggaaatatgattttttggttcatattcagtatcgttggtcaacctatgtgtgtactgctatactaccatgacttgatgaataggaaaggcaaacttgactga

SEQ ID NO: 187 - protein, 504 aa, Glycine max
MAISDEPESVATALNHSSLRRRPAATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFIVEKLAQRKCIPEPVVVVLHIIITSTSLFYPVLVILKCDSAFVSGVVLMLFSCVVWLKLVSFAHTNYDMRALTKLVEKGEALLDTLNMDYPYNVSFKSLAYFLLAPTLCYQPSYPRTPYIRKGWLFRQLVKLIVFTGVMGFIIEQYINPIVQNSQHPLKGNLLYATERVLKLSVPNLYVWLCMFYSFFHLWLNIVAELLRFGDREFYKDWWNAKTVEDYWRMWNMPVHKWMIRHLYFPCLRHGLPKAAALLIAFLVSALFHELCIAVPCHMFKLWAFGGIMFQVPLVLITNYLQNKFRNSMVGNMIFWFIFSIVGQPMCVLLYYHDLMNRKGKLD

SEQ ID NO: 188 - DNA, 1515 bp, Glycine max
atggcgatttccgatgagcctgaaagtgtagccactgctctcaaccactcttccctgcgccgccgtcccgccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagttcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcgtgttaatgctgttttcttgtgttgtatggttaaaattggtgtcttatgcacatacaaactatgatatgagagcacttaccaaattagttgaaaagggagaagcactgctcgatactctgaacatggactatccttacaacgtaaccttcaagagcttggcatatttcctgcttgcccctacattatgttaccagccaagctatcctcgcacaccttatattcgaaagggttggttgtttcgccaacttctcaagctgataatatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattcctttttccacctttggttaaatatcgtggcagagcttcttcgatttggtgatcgtgaattctacaaggattggtggaatgccaaaactgtcgaagattattggaggatgtggaatatgcctgttcacaaatggatgatccgccacctatattttccatgtttaaggcacggtctaccaaaggctgctgctcttttaattgccttcctggtttctgctttattccatgagctgtgcattgctgttccttgccacatgttcaagttgtgggctttcggtggaattatgtttcaggttcctttggtcttgatcactaattatctgcaaaataaattcagaaactcaatggttggaaatatgattttttggttcagtttcagtatcgttggtcaacctatgtgtgtactgctatactaccatgacttgatgaataggaaaggcaaacttgactga

SEQ ID NO: 189 - protein, 504 aa, Glycine max
MAISDEPESVATALNHSSLRRRPAATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQRKCIPEPVVVVLHIIITSTSLFYPVLVILKCDSAFVSGVVLMLFSCVVWLKLVSYAHTNYDMRALTKLVEKGEALLDTLNMDYPYNVTFKSLAYFLLAPTLCYQPSYPRTPYIRKGWLFRQLLKLIIFTGVMGFIIEQYINPIVQNSQHPLKGNLLYATERVLKLSVPNLYVWLCMFYSFFHLWLNIVAELLRFGDREFYKDWWNAKTVEDYWRMWNMPVHKWMIRHLYFPCLRHGLPKAAALLIAFLVSALFHELCIAVPCHMFKLWAFGGIMFQVPLVLITNYLQNKFRNSMVGNMIFWFSFSIVGQPMCVLLYYHDLMNRKGKLD

SEQ ID NO: 190 - DNA, 1515 bp, Glycine max
atggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagttcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcacgttaatgctgttttcttgtgttgtatggttaaaattggtgtcttatgcacatacaaactatgatatgagagcacttaccaaattagttgaaaagggagaagcactgctcgatactctgaacatggactatccttacaacgtaaccttcaagagcttggcatatttcctgcttgcccctacattatgttaccagccaagctatcctcgcacaccttatattcgaaagggttggttgtttcgccaacttctcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattcctttttccacctttggttaaatatcgtggcagagcttcttcgatttggtgatcgtgaattctacaaggattggtggaatgccaaaactgtcgaagattattggaggatgtggaatatgcctgttcacaaatggatgagacgccacctatattttccatgtttaaggcacggtctaccaaaggctgctgctcttttaattgccttcctggtttctgctttattccatgagctgtgcattgctgttccttgccacatattcaagttgtgggctttcggtggaattatgtttcaggttcctttggtcttgatcactaattatctgcaaaataaattcagaaactcaatggttggaaatatgattttttggttcagtttcagtatccttggtcaacctatgtgtgtactgctatactaccatgacttgatgaataggaaaggcaaacttgactga

SEQ ID NO: 191 - protein, 504 aa, Glycine max
MAISDEPESVATALNHSSLRRRPSATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQRKCIPEPVVVVLHIIITSTSLFYPVLVILKCDSAFVSGVTLMLFSCVVWLKLVSYAHTNYDMRALTKLVEKGEALLDTLNMDYPYNVTFKSLAYFLLAPTLCYQPSYPRTPYIRKGWLFRQLLKLIVFTGVMGFIIEQYINPIVQNSQHPLKGNLLYATERVLKLSVPNLYVWLCMFYSFFHLWLNIVAELLRFGDREFYKDWWNAKTVEDYWRMWNMPVHKWMRRHLYFPCLRHGLPKAAALLIAFLVSALFHELCIAVPCHIFKLWAFGGIMFQVPLVLITNYLQNKFRNSMVGNMIFWFSFSILGQPMCVLLYYHDLMNRKGKLD

SEQ ID NO: 192 - DNA, 1515 bp, Glycine max
atggcgatttccgatgagcctgaaagtgtagccactgctctcaaccactcttccctgcgccgccgtcccgccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaagtgtgattctgcttttgtatcaggtgtcgtgttaatgctgttttcttgtgttgtatggttaaaattggtgtcttttgcacatacaaactatgatatgagagcacttaccaaattagttgaaaagggagaagcactgctcgatactctgaacatggactatccttacaacgtaaccttcaagagcttggcatatttcctgcttgcccctacattatgttaccagccaagctatcctcgcacaccttatattcgaaagggttggttgtttcgccaacttctcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattcctttttccacctttggttaaatatcgtggcagagcttcttcgatttggtgatcgtgaattctacaaggattggtggaatgccaaaactgtcgaagattattggaggatgtggaatatgcctgttcacaaatggatgagacgccacctatattttccatgtttaaggcacggtctaccaaaggctgctgctcttttaattgccttcctggtttctgctttattccatgagctgtgcattgctgttccttgccacatgttcaagttgtgggctttcggtggaattatgtttcaggttcctttggtcttgatcactaattatctgcaaaataaattcagaaactcaatggttggaaatatgattttttggttcagtttcagtatcgttggtcaacctatgtgtgtactgctatactaccatgacttgatgaataggaaaggcaaacttgactga

SEQ ID NO: 193 - protein, 504 aa, Glycine max
MAISDEPESVATALNHSSLRRRPAATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFIVEKLAQRKCIPEPVVVVLHIIITSTSLFYPVLVILKCDSAFVSGVVLMLFSCVVWLKLVSFAHTNYDMRALTKLVEKGEALLDTLNMDYPYNVTFKSLAYFLLAPTLCYQPSYPRTPYIRKGWLFRQLLKLIVFTGVMGFIIEQYINPIVQNSQHPLKGNLLYATERVLKLSVPNLYVWLCMFYSFFHLWLNIVAELLRFGDREFYKDWWNAKTVEDYWRMWNMPVHKWMRRHLYFPCLRHGLPKAAALLIAFLVSALFHELCIAVPCHMFKLWAFGGIMFQVPLVLITNYLQNKFRNSMVGNMIFWFSFSIVGQPMCVLLYYHDLMNRKGKLD

SEQ ID NO: 194 - DNA, 1515 bp, Glycine max
atggcgatttccgatgagcctgaaagtgtagccactgctctcaaccactcttccctgcgccgccgtcccgccgccacctccaccgccggcctcttcaattcgcctgagacaaccaccgacagttccggtgatgacttggccaaggattctggttccgacgactccatcaacaacgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagtgcaaagtcattgagagactggccccttttcatgtgttgtctttctcttgtggtatttcctttcgctgcctttatggtggagaagttggcacaacggaagtgtatacccgaaccagttgttgttgtacttcatataatcattacctcaacttcgcttttctatccagttttagttattctcaagtgtgattctgcttttgtatcaggtgtcgtgttaatgctgttttcttgtgttgtatggttaaaattggtgtcttttgcacatacaaactatgatatgagagcacttaccaaattagttgaaaagggagaagcactgctcgatactctgaacatggagtatccttacaacgtaaccttcaagagcttggcatatttcctgcttgcccctacattatgttaccagccaagctatcctcgcacaccttatattcgaaagggttggttgtttcgccaacttctcaagctgatagtatttacaggagttatgggatttataatagaacaatatattaatcccatagtacaaaattcacagcatcctctcaagggaaaccttctttacgccaccgagagagttctgaagctttctgttccaaatttatatgtgtggctctgcatgttctattcctttttccacctttggttaaatatcgtggcagagcttcttcgatttggtgatcgtgaattctacaaggattggtggaatgccaaaactgtcgaagattattggaggatgtggaatatgcctgttcacaaatggatgagacgccacctatattttccatgtttaaggcacggtctaccaaaggctgctgctcttttaatttccttcctggtttctgctttattccatgagctgtgcattgctgttccttgccacatgttcaagttgtgggctttcggtggaattatgtttcaggttcctttggtcttgatcactaattatctgcaaaataaattcaaaaactcaatggttggaaatatgattttttggttcagtttcagtatcgttggtcaacctatgtgtgtactgctatactaccatgacttgatgaataggaaaggcaaacttgactga

SEQ ID NO: 195 - protein, 504 aa, Glycine max
MAISDEPESVATALNHSSLRRRPAATSTAGLFNSPETTTDSSGDDLAKDSGSDDSINNDDAAVNSQQQNEKQDTDFSVLKFAYRPSVPAHRKVKESPLSSDTIFRQSHAGLFNLCIVVLVAVNSRLIIENLMKYGWLIKSGFWFSAKSLRDWPLFMCCLSLVVFPFAAFMVEKLAQRKCIPEPVVVVLHIIITSTSLFYPVLVILKCDSAFVSGVVLMLFSCVVWLKLVSFAHTNYDMRALTKLVEKGEALLDTLNMEYPYNVTFKSLAYFLLAPTLCYQPSYPRTPYIRKGWLFRQLLKLIVFTGVMGFIIEQYINPIVQNSQHPLKGNLLYATERVLKLSVPNLYVWLCMFYSFFHLWLNIVAELLRFGDREFYKDWWNAKTVEDYWRMWNMPVHKWMRRHLYFPCLRHGLPKAAALLISFLVSALFHELCIAVPCHMFKLWAFGGIMFQVPLVLITNYLQNKFKNSMVGNMIFWFSFSIVGQPMCVLLYYHDLMNRKGKLD

SEQ ID NO: 196 - protein, 498 aa, Glycine max
MAISDEPETVATALNHSSLRRRPTAAGLFNSPETTTDSSGDDLAKDSGSDDSISSDAANSQPQQKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQQKCIPEPVVVVLHIIITSASLFYPVLVILRCDSAFLSGVTLMLFACVVWLKLVSYAHTNYDMRALTKSVEKGEALPDTLNMDYPYNVSFKSLAYFLVAPTLCYQPSYPRTPYIRKGWLFRQLVKLIIFTGVMGFIIEQYINPIVQNSQHPLKGNLLYAIERVLKLSVPNLYVWLCMFYCFFHLWLNILAELLRFGDREFYQDWWNAKTVEDYWRMWNMPVHKWMIRHLYFPCLRHGIPKAVALLIAFLVSALFHELCIAVPCHIFKLWAFGGIMFQVPLVFITNYLQNKFRNSMVGNMIFWFIFSILGQPMCVLLYYHDLMNRKGKLD

SEQ ID NO: 197 - protein, 498 aa, Glycine max
MAISDEPETVATALNHSSLRRRPTAAGLFNSPETTTDSSGDDLAKDSGSDDSISSDAANSQPQQKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQQKCIPEPVVVVLHIIITSASLFYPVLVILRCDSAFLSGVTLMLFACVVWLKLVSYAHTNYDMRALTKSVEKGEALPDTLNMDYPYNVSFKSLAYFLVAPTLCYQPSYPRTPYIRKGWLFRQLVKLIIFTGVMGFIIEQYINPIVQNSQHPLKGNLLYAIERVLKLSVPNLYVWLCMFYCFFHLWLNILAELLRFGGREFYQDWWNAKTVEDYWRMWNMPVHKWMIRHLYFPCLRHGIPKAVALLIAFLVSALFHELCIAVPCHIFKLWAFGGIMFQVPLVFITNYLQNKFRNSMVGNMIFWFIFSILGHPMCVLLYYHDLMNRKGKLD

SEQ ID NO: 198 - protein, 504 aa, Glycine max
MAISDEPESVATALNHSSLRRRPSATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQRKCIPEPVVVVLHIIITSTSLFYPVLVILRCDSAFVSGVTLMLFSCVVWLKLVSYAHTNYDMRALTKLVEKGEALLDTLNMDYPYNVSFKSLAYFLVAPTLCYQPSYPRTPYIRKGWLFRQLVKLIIFTGVMGFIIEQYINPIVQNSQHPLKGNLLYATERVLKLSVPNLYVWLCMFYCFFHLWLNILAELLRFGDREFYKDWWNAKTVEDYWRMWNMPVHKWMIRHLYYPCLRHGLPKAAALLIAFLVSALFHELCIAVPCHIFKLWAFGGIMFQVPLVLITNYLQNKFRNSMVGNMIFWFIFSILGQPMCVLLYYHDLMNRKGKLD

SEQ ID NO: 199 - protein, 494 aa, Zea mays
MAPPPSMPAASDRAGPGRDAGDSSSLRLRRAPSADAGDLAGDSSVGLRENGEPQPPTNPPPQEQQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYCFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFFSIVGQPMCVLLYYHDVMNRQAQASR

SEQ ID NO: 200 - protein, 547 aa, Arabidopsis thaliana
MAILDSAGVTTVTENGGGEFVDLDRLRRRKSRSDSSNGLLLSGSDNNSPSDDVGAPADVRDRIDSVVNDDAQGTANLAGDNNGGGDNNGGGRGGGEGRGNADATFTYRPSVPAHRRARESPLSSDAIFKQSHAGLFNLCVVVLIAVNSRLIIENLMKSHAGLFNLCVVVLIAVNSRLIIENLMKYGWLIRTDFWFSSRSLRDWPLFMCCISLSIFPLAAFTVEKLVLQKYISEPVVIFLHIIITMTEVLYPVYVTLRCDSAFLSGVTLMLLTCIVWLKLVSYAHTSYDIRSLANAADKANPEVSYYVSLKSLAYFMVAPTLCYQPSYPRSACIRKGWVARQFAKLVIFTGFMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHIYFPCLRSKIPKTLAIIIAFLVSAVFHELCIAVPCRLFKLWAFLGIMFQVPLVFITNYLQERFGSTVGNMIFWFIFCIFGQPMCVLLYYHDLMNRKGSMS

SEQ ID NO: 201 - protein, 518 aa, Vitis vinifera
MAICNSPVSVTTSSSSSHADSDLDFSIRKRFGGKGKAVADSSLETETEAAAAAVLEAEKSVGEVGSGGDRGESGSQVVRNGENGVAEVAAKFAYRPCAPAHRKVKESPLSSDAIFRQSHAGLFNLCIVVLVAVNSRLIIENLMKYGWLIRAGFWFSSKSLRDWPLFMCCLTLPIFPLAAFVVEKLAQQKYISEQVVVSLHIIITTAAVLFPVLVILRCDSAVLSGVTLMLFACIVWLKLVSFAHTNYDMRAVAKLIDKGDDLSTSLNMDYPYDVNFKSLAYFMVAPTLCYQPSYPRSTCIRKGWVFRQFVKLAIFTGVMGFIIEQYINPIVQNSQHPLKGNFFYALERILKLSVPNLYVWLCMFYCFFHLWLNILAELLRFGDREFYKDWWNAKTVEEYWRMWNMPVHKWMVRHLYFPCLRNGISKGVSVVIAFAISAIFHELCIAVPCHMFKLWAFIGIMFQVPLVLVTNYLQNKFRNSMVGNMIFWLFFSILGQPMCVLLYYHDLMNRKETTESSL

SEQ ID NO: 202 - protein, 502 aa, Vitis vinifera
  misc_feature (499)..(499): Xaa can be any naturally occurring amino acid
MAICNSPVSVTTSSSSSHADSDLDFSIRKRFGGKGKAVADSSLETETEAAAAAVLEAEKSVVRNGENGVAEVAAKFAYRPCAPAHRKVKESPLSSDAIFRQSHAGLFNLCIVVLVAVNSRLIIENLMKYGWLIRAGFWFSSKSLRDWPLFMCCLTLPIFPLAAFVVEKLAQQKYISEQVVVSLHIIITTAAVLFPVLVILRCDSAVLSGVTLMLFACIVWLKLVSFAHTNYDMRAVAKLIDKGDDLSTSLNMDYPYDVNFKSLAYFMVAPTLCYQPSYPRSTCIRKGWVFRQFVKLAIFTGVMGFIIEQYINPIVQNSQHPLKGNFFYALERILKLSVPNLYVWLCMFYCFFHLWLNILAELLRFGDREFYKDWWNAKTVEEYWRMWNMPVHKWMVRHLYFPCLRNGISKGVSVVIAFAISAIFHELCIAVPCHMFKLWAFIGIMFQVPLVLVTNYLQNKFRNSMVGNMIFWLFFSILGQPMCVLLYYHDLMNRKETTXSSL

SEQ ID NO: 203 - protein, 517 aa, Vernonia galamensis
MALLDTPQIGEITTTATTTIRQHPLGKPDAGIGDGLFSSSSSKTNSSFEDGDSLNGDFNDKFKEQIGAGDESKKGNGKIDHGGVKKGRETTVVHYAYRPSSPAHRRIKESPLSSDAIFKQSHAGLFNLCIVVLVAVNGRLIIENLMKYGLLINSKFWFSSRSLRDWPLLMCWLTPSDFPLAAYIVEKLAWKKRISDPVVITLHVVITTTAILYPIFMILRFDSVVLLGVSLMLCACINWLKLVSFVHTNYDMRSLLNSTGKGEVEPMSSNMDYFYDINFKSLVYFMVAPTLCYQISYPRTAFIRKGWVFRQLIKLVIFTGFMGFIIEQYINPIVKNSRHPLNGDFLYAIERVLKVSVPNLYVWLCMFYCFFHLWLNILAELLWFGDREFYKDWWNTQTIEEYWRLWNMPVHKWIVRHLYFPCLRNGISKGAAILVAFFMSAVFHELCIAVPCHILKFWAFIGIMFQVPLVLLTNYLQHKFQNSMVGNMIFWCFFSIFGQPMCVFLYYHEVNQKGKSK

SEQ ID NO: 204 - protein, 523 aa, Vernonia galamensis
MALLDTPQIGEITTTATTTIRRRTTVKPDAGIGDGLFDSSSSSKTNSSFEDGDSLNGDFNDKFKEQIGAGDESKDDSKGNGQKIDHGGVKKGRETTVVHYAYRPSSPAHRRIKESPLSSDAIFKQSHAGLFNLCIVVLVAVNGRLIIENLMKYGLLINSNFWFSSRSLRDWPLLMCCLTPSDFPLAAYIVEKLAWKKRISDPVVITLHVIITTTAILYPVFMILRFDSVVLSGVSLMLCACINWLKLVSFVHTNYDMRSLLNSTDKGEVEPMSSNMDYFYDVNFKSLVYFMVAPTLCYQISYPRTAFIRKGWVLRQLIKLVIFTGFMGFIIEQYINPIVKNSRHPLKGDFLYAIERVLKLSVPNLYVWLCMFYCFFHLWLNILAELLCFGDREFYKDWWNAQTIEEYWRLWNMPVHKWIVRHLYFPCLRNGIPKGAAILVAFFMSAVFHELCIAVPCHIFKFWAFIGIMFQVPLVLLTNYLQHKFQNSMVGNMIFWCFFSIFGQPMCVLLYYHDVMNQKGKSK

SEQ ID NO: 205 - protein, 526 aa, Vernicia fordii
MTIPETPDNSTDATTSGGAESSSDLNLSLRRRRTASNSDGAVAELASKIDELESDAGGGQVIKDPGAEMDSGTLKSNGKDCGTVKDRIENRENRGGSDVKFTYRPSVPAHRALKESPLSSDNIFKQSHAGLFNLCIVVLVAVNSRLIIENIMKYGWLIKTGFWFSSRSLRDWPLLMCCLTLPIFSLAAYLVEKLACRKYISAPTVVFLHILFSSTAVLYPVSVILSCESAVLSGVALMLFACIVWLKLVSYAHTNFDMRAIANSVDKGDALSNASSAESSHDVSFKSLVYFMVAPTLCYQPSYPRTASIRKGWVVRQFVKLIIFTGFMGFIIEQYINPIVQNSQHPLKGDLLYAIERVLKLSVPNLYVWLCMFYCFFHLWLNILAELLRFGDREFYKDWWNARTVEEYWRMWNMPVHKWMVRHIYFPCLRHKIPRGVALLITFFVSAVFHELCIAVPCHIFKLWAFIGIMFQIPLVGITNYLQNKFRSSMVGNMIFWFIFCILGQPMCLLLYYHDLMNRKGTTESR

SEQ ID NO: 206 - protein, 518 aa, Tropaeolum majus
MAVAESSQNTTTMSGHGDSDLNNFRRRKPSSSVIEPSSSGFTSTNGVPATGHVAENRDQDRVGAMENATGSVNLIGNGGGVVIGNEEKQVGETDIRFTYRPSFPAHRRVRESPLSSDAIFKQSHAGLFNLCIVVLIAVNSRLIIENLMKYGWLIDTGFWFSSRSLGDWSIFMCCLTLPIFPLAAFIVEKLVQRNHISELVAVLLHVIVSTAAVLYPVIVILTCDSVYMSGVVLMLFGCIMWLKLVSYAHTSSDIRTLAKSGYKGDAHPNSTIVSCSYDVSLKSLAYFMVAPTLCYQPSYPRSSCIRKGWVVRQFVKLIVFIGLMGFIIEQYINPIVRNSKHPLKGDFLYAIERVLKLSVPNLYVWLCMFYSFFHLWLNILAELLRFGDREFYKDWWNAKTVAEYWKMWNMPVHRWMVRHLYFPCLRNGIPKEGAIIIAFLVSGAFHELCIAVPCHVFKLWAFIGIMFQVPLVLITNYLQEKFSNSMVGNMIFWFIFCILGQPMCVLLYYHDLINLKEK

SEQ ID NO: 207 - protein, 446 aa, Populus trichocarpa
MMESEDLKSNGKECDKVTNENRSDIKFNYRPSMPAHRGVRESPLSSDAIFKQSHAGLFNLCIVVLVAINSRLIIENIIKYGWLINGGFWFSSKSLRDWPLFMCCLSLPAFPFAAYLVEKLAYQNYLPQLVVVFLHTIITTGSLLYPVLVILRCDSAFLSGVTLMLFSCIVWLKLVSYAHTNSDLRAIAKSIDREDVPSISPYVGNPYDTYFKSLVYFMVAPTLCYQSSYPRTESVRKGWVVQQFVKLIIFTGFMGFIIEQYINPIVKNSQHPFKGNLLYAIERVLKLSVPNLYVWLCMFYCFFHLWLNILAELLCFGDREFYKDWWNARTVEEYWRMWNMPVHKWMVRHIYFPCLRNKIPKGLAILIAFLVSAVFHELCIAVPCHVFKLWAFIGIMLQVPLVVITKFLQNKFRSSMVGNMIFWLFFSILGQPMCVLLYYHDLMNRK

SEQ ID NO: 208 - protein, 534 aa, Perilla frutescens
MAILDSPEILDTTSSSADNGAAHHTTLRRRQSARSVPPLLDSDSNSLEAESAINDSENVRNDANLIENLRGGAVESENEKQESYGKEEGAKVKENGETSNGNGTDVMAVKFTFRPAAPAHRKNKESPLSSDAIFKQSHAGLFNLCIVVLVAVNSRLIIENLMKYGWLIKSGFWFSSTSLRDWPLLMCCLSLPVFALASFLVEKLVKLNYIPEWVAVFLHVTITTVEILFPVVVILRCDSAVLSGVTLMLFACTVWLKLVSYAHTNYDLRVLAKSLDKWEAMSRYWNLDYAYDVSFKSLAYFMVAPTLCYQPSYPRTACIRKGWVVRQLIKLVIFTGLMGFIIEQYINPIVQNSQHPLKGNLLYAIERVLKLSVPNLYVWLCMFYCFFHLWLNILAELLCFGDREFYKDWWNARTVEEYWRMWNMPVHKWMVRHIYCPCLQNGIPKIVAVLIAFLVSAIFHELCVAVPCQIFKFWAFSGIMLQVPLVIVTNYLQEKFKNSMVGNMMFWCFFCIFGQPMCVLLYYHDLMNRKASAR

SEQ ID NO: 209 - protein, 538 aa, Oryza sativa
MVGSDGDGDGGGGEAHAPAAPAHHHRRPPRPRGGSGAIVEGFAAALRRRIRSGAAAAARASFGGDSGDEAASGEPSSSSSSSPSRRRGGDSNGAEASSAAGGGGGRGGGGDFSAFTFRAAAPVHRKAKESPLSSDAIFKQSHAGLFNLCIVVLVAVNSRLIIENLMKYGLLIRAGFWFNDKSLRDWPLLMCCLSLPAFPLGAFAVEKLAFNNVITDAVATCLHIFLSTTEIVYPVLVILKCDSAVLSGFLLIFIACIVWLKLVSFAHTNHDIRQLTMGGKKVDNELSTVDMDNLQPPTLGNLIYFMMAPTLCYQPSYPRTSCVRKGWLIRQIILYLIFTGLQGFIIEQYINPIVVNSQHPLKGGLLNAVETVLKLSLPNVYLWLCMFYAFFHLWLSILAEILRFGDREFYKDWWNAKTIDEYWRKWNMPVHKWVVRHIYFPCMRNGISKEVAVLISFLVSAVLHEICVAVPCRILKFWAFLGIMLQIPLIVLTAYLKSKFRDTMVGNMIFWFFFCIYGQPMCLLLYYHDVMNRIEKAR

SEQ ID NO: 210 - protein, 477 aa, Oryza sativa
MAPPPSLAPDRGGGEPDDALRLRARAAAAAGDAPAPQQQQEQRHQEQQQQLLWYRASAPAHRRVRESPLSSDAIFRQSHAGLLNLCIVVLVAVNSRLIIENLMKYGLLIRAGFWFSGTSLADWPLLMCCLTLPTFPLAALMVEKLAQRKLISKHVVILLHIVITTSVLVYPVVVILKCDSAVLSGFVLMFLASIIWLKLVSFAHTNYDIRMLSKSIEKGVTHDISIDPENIKWPTFKRLSYFMLAPTLCYQPSYPRTTYIRKGWVVRQLIKCLVFTGLMGFIIEQYINPIVKNSKHPLKGNFLNAIERVLKLSVPTLYVWLCMFYCFFHLWLNILAELLCFGDREFYKDWWNAKTVEEYWRMWNMPVHKWVIRHIYFPCIRNGFSKVISICIIYFIVLIDLQLCVAVPCHIFKFWAFIGIMFQIPLVFLTKYLQDKFNNTMVGNMIFWFFFSILGQPMCVLLYYHDVMNRQQAQTNR

SEQ ID NO: 211 - protein, 504 aa, Oryza sativa
MVGSDGDGDGGGGEAHAPAAPAHHHRRPPRPRGGSGAIVEGFAAALRRRIRSGAAAAARASFGGDSGDEAASGEPSSSSSSSPSRRRGGDSNGAEASSAAGGGGGRGGGGDFSAFTFRAAAPVHRKAKESPLSSDAIFKQYGLLIRAGFWFNDKSLRDWPLLMCCLSLPAFPLGAFAVEKLAFNNVITDAVATCLHIFLSTTEIVYPVLVILKCDSAVLSGFLLIFIACIVWLKLVSFAHTNHDIRQLTMGGKKVDNELSTVDMDNLQPPTLGNLIYFMMAPTLCYQPSYPRTSCVRKGWLIRQIILYLIFTGLQGFIIEQYINPIVVNSQHPLKGGLLNAVETVLKLSLPNVYLWLCMFYAFFHLWLSILAEILRFGDREFYKDWWNAKTIDEPVHKWVVRHIYFPCMRNGISKEVAVLISFLVSAVLHEICVAVPCRILKFWAFLGIMLQIPLIVLTAYLKSKFRDTMVGNMIFWFFFCIYGQPMCLLLYYHDVMNRIEKAR

SEQ ID NO: 212 - protein, 532 aa, Olea europaea
MTIPELPESLETTTLNSHHSRAASTVRRRSIDVAVLESDSNSLEAVNDSDSDVNNTNEMGNLRGGVVESALEEPSELGTEGLRNGKEENEHVRTGESNQEMEVLASAKFAHRPSAPVHRRIKESPLSSDAIFKQSHAGLFNLCIVVLVAVNSRLIIENLMKYGWLINSGFWFSSTSLKDWPLLMCCLSLPIFPLAAFFVEKLVLLKYISECVAVFLHILITTAAILYPVLVILRCDSAVLSGVTLMLFACIVWLKLVSYAHASHDMRALAKSLDKGETLSGYWNSDDSYGASFQSLAYFMVAPTLCYQPSYPRTSCIRKGWVVRQLIKLIIFTGFMGFIVEQYINPIVRNSQHPLKGNLLYAIERVLKLSVPNLYVWLCMFYCFFHLWLNILAELLCFGDREFYKDWWNAKTVEEYWRMWNMPVHKWMVRHIYFPCLRNGMPRGGAILIAFLISAIFHELCIAVPCHIFKFWAFIGIMFQVPLVILTNYLQDKFQNSMVGNMIFWCFFSILGQPMCLLLYYHDLMNRKASAK

SEQ ID NO: 213 - protein, 539 aa, Medicago truncatula
MAISDTPETTATATATVTTIETDTDLKRSSLRRRPSATSTAGGLFDAESAAADAVRDSGSDDSLNGKINNEEEVKDRKTDHAEGIVDDDDDNAVKKNGGNDVINDRENVAVDFKFTYRPSVPAHRRSKESPLSSGNIFRQSHAGLFNLCIVVLVAVNSRLIIENLMKYGWLIRSGFWFSSKSLRDWPLFMCCLSLAIFPLAAFVVEKLAQQKRISEPVIVLLHIVITTVAIIYPVLVILWCDSAFLSGSTLMLLTCIVWLKLVSYAHTTYDMRALAVSNEKGETMPDTFNMEEYPHNVSFQSLAYFMVAPTLCYQPSYPRTPSVRKGWVCRQLLKLVIFTGVMGFIIEQYMNPIVQNSQHPLKGNLLYAIERVLKLSVPNVYVWLCMFYCFFHLWLNILAELLRFGDREFYKDWWNAQTVEEYWRMWNMPVHKWMVRHVYFPCIRFGIPKGAAALTAFLVSAVFHELCIAVPCRMFKLWAFIGIMFQVPLVLITNYLKNKYRNSMVGNMIFWFIFCILGQPMCVLLYYHDLMNRKGEID

SEQ ID NO: 214 - protein, 511 aa, Lotus japonicus
MAISEDSESLFAAAAASSVIQSGSSVRRRPSAISAVATVEDESSSEEPVPVRDSGSDVDDSVSSEQHVSPATANREKNQVHDISATKFAYRPSAPAHRRVKESPLSSDNIFRHHAGLFNLCIVVLVAVNSRLIIENLMKYGWLIRTGFWFSSKSLRDWPLFMCCLSLAIFPFAAFVVEKLVQQKCISEPVVVLHIFISTAAVVYPVLVILRTDSAFPSGVTLMLFACIVWLKLVSYAHTNYDMRELTKSIEKGEALPNTLNMDYSYDVSFKSLAYFMIAPTLCYQPRYPRSPSIRKGWVLRQLVKLIIFTGVMGFIIEQYINPIVQNSQHPLKGNLLYAIERVLKLSVPNLYVWLCMFYCFFHLWLNILAELLRFGDREFYKDWWNAKTFEEYWRMWNMPVHKWMIRHLYFPCLRNGIPKGVAILIAFLVSALFHELCIAVPCHIFKLWAFGGIMFQVPLILITNYLQNKFRNSMVGNMIFWFIFSILGQPMAVLLYYHDLMNRKSKLDQS

SEQ ID NO: 215 - protein, 521 aa, Jatropha curas
MTILETTTSGGDGVAESSSDLNVSLRRRRKGTSSDGALPELTSNIVELESESGGQVMMDPGMVTEPETEKINGKDCGGDKDKIDNRENRGRSDIKFTYRPSVPAHRALRESPLSSDAIFKQSHAGLFNLCIVVLVAVNSRLIIENLMKYGWLIKTGFWFSSRSLRDWPLLMCCLTLPIFSLAAYLVEKLAYRKYISAPIVIFFHMLITTTAVLYPVSVILSCGSAVLSGVALMLFACIVWLKLVSYAHTNYDMRAIANSADKGDALSDTSGADSSRDVSFKSLVYFMVAPTLCYQPSYPRTDSVRKGWVVRQFVKLIIFTGFMGFIIEQYINPIVQNSQHPLKGDLLYAIERVLKLSVPNLYVWLCMFYCFFHLWLNILAELLRFGDREFYKDWWNARTVEEYWRMWNMPVHKWMVRHIYFPCLRHKIPRGVALLIAFFVSAVFHELCIAVPCHMFKLWAFIGIMFQIPLVGITNYLQNKFRSSMVGNMIFWFIFCILGQPMCVLLYYHDLMNRKGNAELR

SEQ ID NO: 216 - protein, 507 aa, Euonymus alatus
MANNLNEASDLNFSLRRRTGGISSTTVPDSSSETSSSEADYLDGGKGAADVKDRGDGAVEFQNSMKNVERIEKHESRVGLDSRFTYRPSVPAHRTIKESPLSSDAIFKQSHAGLFNLCIVVLVAVNSRLIIENLMKYGWLIRSGFWFSSRSLRDWPLFMCCLTLPVFPLAAFLFEKLAQKNLISEPVVVLLHIVNTTAAVLYPVLVILRCDSAFMSGVTLMLFACIVWLKLVSYAHTNYDMRALTKSVEKGDTPLSSQNMDYSFDVNIKSLAYFMVAPTLCYQISYPRTPYVRKGWVVRQFVKLIIFTGLMGFIIEQYINPIVQNSQHPLKGNFLYAIERVLKLSVPNLYVWLCMFYCLFHLWLNILAELLCFGDREFYKDWWNAKTVEEYWRMWNMPVHKWMVRHIYFPCLRNGIPKGVAFVISFLVSAVFHELCIAVPCHIFKLWAFFGIMLQVPLVLITSYLQNKFRSSMVGNMMFWFSFCIFGQPMCLLLYYHDLMNRNGKME

SEQ ID NO: 217 - protein, 501 aa, Brassica napus
MEILDSGGVTMPTENGGADLDTLRHRKPRSDSSNGLLPDSVTVSDADVRDRVDSAVEDTQGKANLAGENEIRESGGEAGGNVDVRYTYRPSVPAHRRVRESPLSSDAIFKQSHAGLFNLCVVVLVAVNSRLIIENLMKYGWLIRTDFWFSSTSLRDWPLFMCCLSLSIFPLAAFTVEKLVLQKCISEPVVIILHIIITMTEVLYPVYVTLRCDSAFLSGVTLMLLTCIVWLKLVSYAHTNYDIRTLANSSDKANPEVSYYVSLKSLAYFMLAPTLCYQPSYPRSPCIRKGWVARQFAKLIIFTGFMGFIIEQYINPIVRNSKHPLKGDLLYGVERVLKLSVPNLYVWLCMFYCFFHLWLNILAELLCFGDREFYKDWWNAKSVGDYWRMWNMPVHKWMVRHVYFPCLRRNIPKVPAIILAFLVSAVFHELCIAVPCRLFKLWAFLGIMFQVPLVFITNYLQERFGSMVGNMIFWFTFCIFGQPMCVLLYYHDLMNRKGKMS

SEQ ID NO: 218 - protein, 503 aa, Brassica juncea
MAILDSGGVAVPPTENGVADLDRLHRRKSRSDSSNGLLSDTSPSDDVGAAAAERDRVDSAAEEEAQGTANLAGGDAETRESAGGDVRFTYRPSVPAHRRTRESPLSSDAIFKQSHAGLFNLCVVVLVAVNSRPIIENLMKYGWLIRTDFWFSSTSLRDWPLFMCCLSLSVFPLAAFTVEKMVLQKFISEPVAIILHVIITLTEVLYPVYVTLRCDSAFLSGVTLMLLTCIVWLKLVSYAHTSYDIRTLANSADKVDPEISYYVSLKSLAYFMVAPTLCYQPSYPRSPCIRKGWVARQFAKLVIFTGLMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHVYFPCLRIKIPKVPAIIIAFLVSAVFHELCIAVPCRLFNLWAFMGIMFQVPLVFITNFLQERFGSMVGNMIFWFSFCIFGQPMCVLLYYHDLMNRKGSMS

SEQ ID NO: 219 - protein, 520 aa, Arabidopsis thaliana; identical to SEQ ID NO: 17

SEQ ID NO: 220 - protein, 494 aa, Zea mays; identical to SEQ ID NO: 19

SEQ ID NO: 221 - protein, 503 aa, Brassica napus
MAILDSGGVAVPPTENGVADLDRLHRRKSSSDSSNGLLSDTSPSDDVGAAAAERDRVDSAAEEEAQGTANLAGGDAETRESAGGDVRFTYRPSVPAHRRTRESPLSSDAIFKQSHAGLFNLCVVVLVAVNSRLIIENLMKYGWLIRTDFWFSSTSLRDWPLFMCCLSLSVFPLAAFTVEKMVLQKFISEPVAIILHVIITMTEVLYPVYVTLRCDSAFLSGVTLMLLTCIVWLKLVSYAHTSYDIRTLANSADKVDPEISYYVSLKSLAYFMVAPTLCYQPSYPRSPCIRKGWVARQLAKLVIFTGLMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHVYFPCLRIKIPKVPAIIIAFLVSAVFHELCIAVPCRLFNLWAFMGIMFQVPLVFITNFLQERFGSMVGNMIFGSASCIFGQPMCGLLYYHDLMNRKGSMS

SEQ ID NO: 222 - protein, 341 aa, Brassica napus
MCCLSLSIFPLAAFTVEKLVLQKCISEPVVIFLHVIITMTEVLYPVYVTLRCDSAFLSGDTLMLLTCIVWLKLVSYAHTNYDIRTLANSSDKANPEVSYYVSLKSLAYFMLAPTLCYQPSYPRSPCIRKGWVARQFAKLVIFTGLMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHVYFPCLRIKIPKVPAIIIAFLVSAVFHELCIAVPCRLFNLWAFMGIMFQVPLVFITNFLQERFGSMVGNMIFGSASCIFGQPMCGLLYYHDLMNRKGSMS

What is claimed is:

1. An isolated polynucleotide comprising:
(a) a nucleotide sequence encoding a polypeptide having diacylglycerol acyltransferase activity wherein the polypeptide has at least 80% amino acid identity, based on the Clustal V method of alignment, when compared to an amino acid sequence as set forth in SEQ ID NOs:8, 10, or 12;
(b) a nucleotide sequence encoding a polypeptide having diacylglycerol acyltransferase activity, wherein the nucleotide sequence has at least 80% sequence identity, based on the BLASTN method of alignment, when compared to a nucleotide sequence as set forth in SEQ ID NO: 7, 9, or 11; or
(c) a complement of the nucleotide sequence of (a) or (b), wherein the complement and the nucleotide sequence consist of the same number of nucleotides and are 100% complementary.

2. The polynucleotide of claim 1 wherein the nucleotide sequence comprises SEQ ID NO: 7, 9, or 11.

3. The isolated polynucleotide of claim 1 or 2 wherein said polynucleotide is obtained from one or more edible nuts.

4. The isolated polynucleotide of claim 3 wherein the edible nut is selected from the group consisting of hazelnut, hickory, pistachio, and pecan.

5. A recombinant DNA construct comprising the isolated polynucleotide of claim 1 or claim 2 operably linked to at least one regulatory sequence.

6. A cell comprising in its genome the recombinant DNA construct of claim 5.

7. The cell of claim 6 wherein said cell is an oilseed plant cell.

8. A transgenic oilseed comprising the recombinant construct of claim 5 in its genome.

9. The oilseed of claim 8 wherein said oilseed is selected from the group consisting of soybean, corn, canola, sunflower, flax, cotton, and safflower.

10. A method for increasing the total fatty acid content of an oilseed comprising:
(a) transforming at least one oilseed cell with the recombinant construct of claim 5;
(b) selecting the transformed oilseed cell(s) of step (a) having an increased total fatty acid content when compared to the total fatty acid content of a null segregant oilseed.

11. The method of claim 10 wherein the oilseed is selected from the group consisting of soybean, corn, canola, sunflower, flax, cotton, and safflower.

12. A method for increasing the total fatty acid content of an oilseed cell comprising:
(a) obtaining an isolated nucleic acid encoding a modified Type 1 diacylglycerol acyltransferase polypeptide such that the modified Type 1 diacylglycerol acyltransferase polypeptide has at least one amino acid substitution selected from the group consisting of:
a non-alanine at a position corresponding to position 12 of SEQ ID NO:12 to alanine,
a non-proline at a position corresponding to position 30 of SEQ ID NO:12 to proline,
a non-alanine at a position corresponding to position 31 of SEQ ID NO:12 to alanine,
a non-serine at a position corresponding to position 48 of SEQ ID NO:12 to serine,
a non-serine at a position corresponding to position 49 of SEQ ID NO:12 to serine,
a non-aspartate at a position corresponding to position 51 of SEQ ID NO:12 to aspartate,
a non-aspartate at a position corresponding to position 52 of SEQ ID NO:12 to aspartate,
a non-threonine at a position corresponding to position 59 of SEQ ID NO:12 to threonine,
a non-threonine at a position corresponding to position 73 of SEQ ID NO:12 to threonine, a non-asparagine at a position corresponding to position 79 of SEQ ID NO:12 to asparagine,
a non-leucine at a position corresponding to position 118 of SEQ ID NO:12 to leucine,
a non-alanine at a position corresponding to position 123 of SEQ ID NO:12 to alanine,
a non-valine at a position corresponding to position 128 of SEQ ID NO:12 to valine,
a non-leucine at a position corresponding to position 139 of SEQ ID NO:12 to leucine,
a non-isoleucine at a position corresponding to position 155 of SEQ ID NO:12 to isoleucine,
a non-alanine at a position corresponding to position 181 of SEQ ID NO:12 to alanine,
a non-serine at a position corresponding to position 184 of SEQ ID NO:12 to serine,
a non-valine at a position corresponding to position 197 of SEQ ID NO:12 to valine,
a non-valine at a position corresponding to position 198 of SEQ ID NO:12 to valine,
a non-methionine at a position corresponding to position 205 of SEQ ID NO:12 to methionine,
a non-threonine at a position corresponding to position 211 of SEQ ID NO:12 to threonine,
a non-histidine at a position corresponding to position 218 of SEQ ID NO:12 to histidine,
a non-valine at a position corresponding to position 222 of SEQ ID NO:12 to valine,
a non-lysine at a position corresponding to position 241 of SEQ ID NO:12 to lysine,
a non-valine at a position corresponding to position 247 of SEQ ID NO:12 to valine,
a non-valine at a position corresponding to position 251 of SEQ ID NO:12 to valine,
a non-serine at a position corresponding to position 256 of SEQ ID NO:12 to serine,
a non-serine at a position corresponding to position 257 of SEQ ID NO:12 to serine,
a non-phenylalanine at a position corresponding to position 266 of SEQ ID NO:12 to phenylalanine,
a non-alanine at a position corresponding to position 267 of SEQ ID NO:12 to alanine,
a non-glutamic acid at a position corresponding to position 281 of SEQ ID NO:12 to glutamic acid,
a non-aspartate at a position corresponding to position 288 of SEQ ID NO:12 to aspartate,
a non-glutamic acid at a position corresponding to position 293 of SEQ ID NO:12 to glutamic acid,
a non-asparagine at a position corresponding to position 294 of SEQ ID NO:12 to asparagine,
a non-threonine at a position corresponding to position 299 of SEQ ID NO:12 to threonine,
a non-asparagine at a position corresponding to position 301 of SEQ ID NO:12 to asparagine,
a non-leucine at a position corresponding to position 308 of SEQ ID NO:12 to leucine,
a non-glycine at a position corresponding to position 327 of SEQ ID NO:12 to glycine,
a non-leucine at a position corresponding to position 329 of SEQ ID NO:12 to leucine,
a non-leucine at a position corresponding to position 334 of SEQ ID NO:12 to leucine,
a non-valine at a position corresponding to position 337 of SEQ ID NO:12 to valine,
a non-valine at a position corresponding to position 338 of SEQ ID NO:12 to valine,
a non-glutamine at a position corresponding to position 356 of SEQ ID NO:12 to glutamine,
a non-asparagine at a position corresponding to position 363 of SEQ ID NO:12 to asparagine,
a non-serine at a position corresponding to position 390 of SEQ ID NO:12 to serine,
a non-valine at a position corresponding to position 399 of SEQ ID NO:12 to valine,
a non-isoleucine at a position corresponding to position 436 of SEQ ID NO:12 to isoleucine,
a non-alanine at a position corresponding to position 451 of SEQ ID NO:12 to alanine,
a non-serine at a position corresponding to position 457 of SEQ ID NO:12 to serine,
a non-methionine at a position corresponding to position 475 of SEQ ID NO:12 to methionine,
a non-phenylalanine at a position corresponding to position 486 of SEQ ID NO:12 to phenylalanine,
a non-isoleucine at a position corresponding to position 488 of SEQ ID NO:12 to isoleucine,
a non-leucine at a position corresponding to position 491 of SEQ ID NO:12 to leucine,
a non-lysine at a position corresponding to position 502 of SEQ ID NO:12 to lysine,
a non-serine at a position corresponding to position 514 of SEQ ID NO:12 to serine,
a non-valine at a position corresponding to position 518 of SEQ ID NO:12 to valine, and
a non-valine at a position corresponding to position 531 of SEQ ID NO:12 to valine, when compared to the unmodified Type 1 diacylglycerol acyltransferase polypeptide, wherein the position corresponding to a position of SEQ ID NO:12 is based on an alignment using Clustal V of SEQ ID NO:12 and the unmodified Type 1 diacylglycerol acyltransferase polypeptide, and wherein said polypeptide has diacylglycerol acyltransferase activity;
(b) making a recombinant DNA construct comprising the isolated nucleic acid of part (a) operably linked to at least one regulatory sequence;
(c) transforming at least one oilseed cell with the recombinant construct of part (c); and
(d) selecting the transformed oilseed cell(s) of step (c) having an increased total fatty acid content when compared to the total fatty acid content of a null segregant oilseed cell.

13. A method for increasing the total fatty acid content of an oilseed cell comprising:
(a) obtaining an isolated nucleic acid encoding a modified Type 1 diacylglycerol acyltransferase polypeptide such that the modified Type 1 diacylglycerol acyltransferase polypeptide has at least one amino acid substitution selected from the group consisting of:
a non-alanine at a position corresponding to position 24 of SEQ ID NO:153 to alanine,
a non-asparagine at a position corresponding to position 58 of SEQ ID NO:153 to asparagine,
a non-alanine at a position corresponding to position 146 of SEQ ID NO:153 to alanine,
a non-methionine at a position corresponding to position 170 of SEQ ID NO:153 to methionine,
a non-lysine at a position corresponding to position 206 of SEQ ID NO:153 to lysine,
a non-valine at a position corresponding to position 216 of SEQ ID NO:153 to valine,
a non-phenylalanine at a position corresponding to position 231 of SEQ ID NO:153 to phenylalanine, a non-glutamic acid at a position corresponding to position 258 of SEQ ID NO:153 to glutamic acid,
a non-threonine at a position corresponding to position 264 of SEQ ID NO:153 to threonine,
a non-leucine at a position corresponding to position 273 of SEQ ID NO:153 to leucine,
a non-leucine at a position corresponding to position 299 of SEQ ID NO:153 to leucine,
a non-valine at a position corresponding to position 303 of SEQ ID NO:153 to valine,
a non-serine at a position corresponding to position 355 of SEQ ID NO:153 to serine,
a non-valine at a position corresponding to position 364 of SEQ ID NO:153 to valine,
a non-arginine at a position corresponding to position 401 of SEQ ID NO:153 to arginine,
a non-serine at a position corresponding to position 422 of SEQ ID NO:153 to serine,
a non-methionine at a position corresponding to position 440 of SEQ ID NO:153 to methionine,
a non-lysine at a position corresponding to position 467 of SEQ ID NO:153 to lysine,
a non-serine at a position corresponding to position 479 of SEQ ID NO:153 to serine, and
a non-valine at a position corresponding to position 483 of SEQ ID NO:153 to valine, when compared to the unmodified Type 1 diacylglycerol acyltransferase polypeptide, wherein the position corresponding to a position of SEQ ID NO:153 is based on an alignment using Clustal V of SEQ ID NO:153 and the unmodified Type 1 diacylglycerol acyltransferase polypeptide, and wherein said polypeptide has diacylglycerol acyltransferase activity;

(b) making a recombinant DNA construct comprising the isolated nucleic acid fragment of part (a) operably linked to at least one regulatory sequence;

(c) transforming at least one oilseed cell with the recombinant construct of part (c); and (d) selecting the transformed oilseed cell(s) of step (c) having an increased total fatty acid content when compared to the total fatty acid content of a null segregant oilseed cell.

14. An isolated nucleic acid encoding a modified Type 1 diacylglycerol acyltransferase polypeptide such that the modified Type 1 diacylglycerol acyltransferase polypeptide has at least one amino acid substitution selected from the group consisting of:

a non-alanine at a position corresponding to position 12 of SEQ ID NO:12 to alanine, a non-proline at a position corresponding to position 30 of SEQ ID NO:12 to proline, a non-alanine at a position corresponding to position 31 of SEQ ID NO:12 to alanine, a non-serine at a position corresponding to position 48 of SEQ ID NO:12 to serine, a non-serine at a position corresponding to position 49 of SEQ ID NO:12 to serine, a non-aspartate at a position corresponding to position 51 of SEQ ID NO:12 to aspartate, a non-aspartate at a position corresponding to position 52 of SEQ ID NO:12 to aspartate, a non-threonine at a position corresponding to position 59 of SEQ ID NO:12 to threonine, a non-threonine at a position corresponding to position 73 of SEQ ID NO:12 to threonine, a non-asparagine at a position corresponding to position 79 of SEQ ID NO:12 to asparagine, a non-leucine at a position corresponding to position 118 of SEQ ID NO:12 to leucine, a non-alanine at a position corresponding to position 123 of SEQ ID NO:12 to alanine, a non-valine at a position corresponding to position 128 of SEQ ID NO:12 to valine, a non-leucine at a position corresponding to position 139 of SEQ ID NO:12 to leucine, a non-isoleucine at a position corresponding to position 155 of SEQ ID NO:12 to isoleucine, a non-alanine at a position corresponding to position 181 of SEQ ID NO:12 to alanine, a non-serine at a position corresponding to position 184 of SEQ ID NO:12 to serine, a non-valine at a position corresponding to position 197 of SEQ ID NO:12 to valine, a non-valine at a position corresponding to position 198 of SEQ ID NO:12 to valine, a non-methionine at a position corresponding to position 205 of SEQ ID NO:12 to methionine, a non-threonine at a position corresponding to position 211 of SEQ ID NO:12 to threonine, a non-histidine at a position corresponding to position 218 of SEQ ID NO:12 to histidine, a non-valine at a position corresponding to position 222 of SEQ ID NO:12 to valine, a non-lysine at a position corresponding to position 241 of SEQ ID NO:12 to lysine, a non-valine at a position corresponding to position 247 of SEQ ID NO:12 to valine, a non-valine at a position corresponding to position 251 of SEQ ID NO:12 to valine, a non-serine at a position corresponding to position 256 of SEQ ID NO:12 to serine, a non-serine at a position corresponding to position 257 of SEQ ID NO:12 to serine, a non-phenylalanine at a position corresponding to position 266 of SEQ ID NO:12 to phenylalanine, a non-alanine at a position corresponding to position 267 of SEQ ID NO:12 to alanine, a non-glutamic acid at a position corresponding to position 281 of SEQ ID NO:12 to glutamic acid, a non-aspartate at a position corresponding to position 288 of SEQ ID NO:12 to aspartate, a non-glutamic acid at a position corresponding to position 293 of SEQ ID NO:12 to glutamic acid, a non-asparagine at a position corresponding to position 294 of SEQ ID NO:12 to asparagine, a non-threonine at a position corresponding to position 299 of SEQ ID NO:12 to threonine, a non-asparagine at a position corresponding to position 301 of SEQ ID NO:12 to asparagine, a non-leucine at a position corresponding to position 308 of SEQ ID NO:12 to leucine, a non-glycine at a position corresponding to position 327 of SEQ ID NO:12 to glycine, a non-leucine at a position corresponding to position 329 of SEQ ID NO:12 to leucine, a non-leucine at a position corresponding to position 334 of SEQ ID NO:12 to leucine, a non-valine at a position corresponding to position 337 of SEQ ID NO:12 to valine, a non-valine at a position corresponding to position 338 of SEQ ID NO:12 to valine, a non-glutamine at a position corresponding to position 356 of SEQ ID NO:12 to glutamine, a non-asparagine at a position corresponding to position 363 of SEQ ID NO:12 to asparagine,
a non-serine at a position corresponding to position 390 of SEQ ID NO:12 to serine,
a non-valine at a position corresponding to position 399 of SEQ ID NO:12 to valine,
a non-isoleucine at a position corresponding to position 436 of SEQ ID NO:12 to isoleucine,
a non-alanine at a position corresponding to position 451 of SEQ ID NO:12 to alanine,
a non-serine at a position corresponding to position 457 of SEQ ID NO:12 to serine,
a non-methionine at a position corresponding to position 475 of SEQ ID NO:12 to methionine,
a non-phenylalanine at a position corresponding to position 486 of SEQ ID NO:12 to phenylalanine,
a non-isoleucine at a position corresponding to position 488 of SEQ ID NO:12 to isoleucine,
a non-leucine at a position corresponding to position 491 of SEQ ID NO:12 to leucine,
a non-lysine at a position corresponding to position 502 of SEQ ID NO:12 to lysine,
a non-serine at a position corresponding to position 514 of SEQ ID NO:12 to serine,
a non-valine at a position corresponding to position 518 of SEQ ID NO:12 to valine, and
a non-valine at a position corresponding to position 531 of SEQ ID NO:12 to valine, when compared to the unmodified Type 1 diacylglycerol acyltransferase polypeptide, wherein the position corresponding to a position of SEQ ID NO:12 is based on an alignment using Clustal V of SEQ ID NO:12 and the unmodified Type 1 diacylglycerol acyltransferase polypeptide, and wherein said polypeptide has diacylglycerol acyltransferase activity.

15. An isolated nucleic acid encoding a modified Type 1 diacylglycerol acyltransferase polypeptide such that the modified Type 1 diacylglycerol acyltransferase polypeptide has at least one amino acid substitution selected from the group consisting of:
a non-alanine at a position corresponding to position 24 of SEQ ID NO:153 to alanine,
a non-asparagine at a position corresponding to position 58 of SEQ ID NO:153 to asparagine,
a non-alanine at a position corresponding to position 146 of SEQ ID NO:153 to alanine,
a non-methionine at a position corresponding to position 170 of SEQ ID NO:153 to methionine,
a non-lysine at a position corresponding to position 206 of SEQ ID NO:153 to lysine,
a non-valine at a position corresponding to position 216 of SEQ ID NO:153 to valine,
a non-phenylalanine at a position corresponding to position 231 of SEQ ID NO:153 to phenylalanine,
a non-glutamic acid at a position corresponding to position 258 of SEQ ID NO:153 to glutamic acid,
a non-threonine at a position corresponding to position 264 of SEQ ID NO:153 to threonine,
a non-leucine at a position corresponding to position 273 of SEQ ID NO:153 to leucine,
a non-leucine at a position corresponding to position 299 of SEQ ID NO:153 to leucine,
a non-valine at a position corresponding to position 303 of SEQ ID NO:153 to valine,
a non-serine at a position corresponding to position 355 of SEQ ID NO:153 to serine,
a non-valine at a position corresponding to position 364 of SEQ ID NO:153 to valine,
a non-arginine at a position corresponding to position 401 of SEQ ID NO:153 to arginine,
a non-serine at a position corresponding to position 422 of SEQ ID NO:153 to serine,
a non-methionine at a position corresponding to position 440 of SEQ ID NO:153 to methionine,
a non-lysine at a position corresponding to position 467 of SEQ ID NO:153 to lysine,
a non-serine at a position corresponding to position 479 of SEQ ID NO:153 to serine, and
a non-valine at a position corresponding to position 483 of SEQ ID NO:153 to valine, when compared to the unmodified Type 1 diacylglycerol acyltransferase polypeptide, wherein the position corresponding to a position of SEQ ID NO:153 is based on an alignment using Clustal V of SEQ ID NO:153 and the unmodified Type 1 diacylglycerol acyltransferase polypeptide, and wherein said polypeptide has diacylglycerol acyltransferase activity.

16. A recombinant DNA construct comprising the isolated nucleic acid of claim 15 or operably linked to at least one regulatory sequence.

17. A cell comprising in its genome the recombinant DNA construct of claim 16.

18. The cell of claim 17 wherein said cell is an oilseed plant cell.

19. A transgenic oilseed comprising the recombinant construct of claim 16 in its genome.

20. The oilseed of claim 19 wherein said oilseed is selected from the group consisting of soybean, corn, canola, sunflower, flax, cotton, and safflower.

21. The cell of claim 6 wherein said cell is a fungal cell or oleaginous microbial organism.

22. The cell of claim 17 wherein said cell is a fungal cell or oleaginous microbial organism.

23. The fungal cell of claim 21 wherein said fungal cell is selected from the group consisting of *Yarrowia, Candida, Rhodotorula, Rhodosporidium, Cryptococcus, Trichosporon* and *Lipomyces*.

24. The fungal cell of claim 22 wherein said fungal cell is selected from the group consisting of *Yarrowia, Candida, Rhodotorula, Rhodosporidium, Cryptococcus, Trichosporon* and *Lipomyces*.

25. The method of claim 13, wherein said polypeptide comprises an amino acid sequence having at least 80% sequence identity to SEQ ID NO:161.

26. The method of claim 13, wherein said polypeptide has the amino acid sequence set forth in SEQ ID NO:161.

27. The method of claim 13, wherein said isolated nucleic acid comprises a polynucleotide having the nucleotide sequence set forth in SEQ ID NO:160.

28. The nucleic acid of claim 15, wherein said encoded polypeptide comprises an amino acid sequence having at least 80% sequence identity to SEQ ID NO:161.

29. The nucleic acid of claim 15, wherein said encoded polypeptide comprises the amino acid sequence set forth in SEQ ID NO:161.

30. The isolated nucleic acid of claim 15, wherein said nucleic acid fragment comprises a polynucleotide having the nucleotide sequence set forth in SEQ ID NO:160.

31. The nucleotide sequence of claim 1 (a), wherein said nucleotide sequence encodes a polypeptide having diacylglycerol acyltransferase activity wherein the polypeptide has at least 90% amino acid identity, based on the Clustal V method of alignment, when compared to an amino acid sequence as set forth in SEQ ID NOs:8, 10 or 12.

32. The nucleotide sequence of claim 1 (a), wherein said nucleotide sequence encodes a polypeptide having diacylglycerol acyltransferase activity wherein the polypeptide has at least 95% amino acid identity, based on the Clustal V method of alignment, when compared to an amino acid sequence as set forth in SEQ ID NOs:8, 10 or 12.

33. An isolated polynucleotide comprising a nucleotide sequence encoding a polypeptide having diacylglycerol acyltransferase activity, wherein the nucleotide sequence hybridizes under stringent conditions to a nucleotide sequence as set forth in SEQ ID NO:7, 9or 11, wherein said stringent conditions include hybridization in 50% formamide, 1M NaCl, 1% SDS at 37° C. and a wash in 0.1×SSC at 60° C. to 65° C.

34. A recombinant DNA construct comprising the isolated nucleic acid of claim 2 operably linked to at least one regulatory sequence.

35. A cell comprising in its genome the recombinant DNA construct of claim 34.

36. The cell of claim 35 wherein said cell is an oilseed plant cell.

37. A transgenic oilseed comprising the recombinant construct of claim 34 in its genome.

38. The oilseed of claim 37 wherein said oilseed is selected from the group consisting of soybean, corn, canola, sunflower, flax, cotton, and safflower.

39. A recombinant DNA construct comprising the isolated nucleic acid of claim 14 operably linked to at least one regulatory sequence.

40. A cell comprising in its genome the recombinant DNA construct of claim 39.

41. The cell of claim 40 wherein said cell is an oilseed plant cell.

42. A transgenic oilseed comprising the recombinant construct of claim 39 in its genome.

43. The oilseed of claim 42 wherein said oilseed is selected from the group consisting of soybean, corn, canola, sunflower, flax, cotton, and safflower.

44. The cell of claim 40 wherein said cell is a fungal cell or oleaginous microbial organism.

45. The fungal cell of claim 44 wherein said fungal cell is selected from the group consisting of *Yarrowia, Candida, Rhodotorula, Rhodosporidium, Cryptococcus, Trichosporon* and *Lipomyces*.

* * * * *